United States Patent 11,446,398 (REGULATED BIOCIRCUIT SYSTEMS) - sequence listing, part 86

SEQ ID NO: 191832 - DNA, 3996 bp, Homo sapiens
  Payload ID: 17907
  Gene Name: TRAF2 and NCK interacting kinase
  Uniprot ID: Q9UKE5
  ENST ID: ENST00000357327
  CDS Start-End: 1-3996
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 191833 - DNA, 6970 bp, Homo sapiens
  Payload ID: 17907
  Gene Name: TRAF2 and NCK interacting kinase
  Uniprot ID: Q9UKE5
  ENST ID: ENST00000436636
  CDS Start-End: 346-4428
attataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaacagaagagcacttggcacttatcttcatggcgttatttctaatttaaaagaacataactcatgtggacttatgccagtctagaggcagaatcagaaggcttggttgaacatatcgctttccctttttcctctccctccgcccctcccagtacagtccatctttcaatgttgcagcctggttgagaaggagagaaaaaggtggcaggaatttccaggagatccccaagaatgctgccttgtctgtggacaaagatggaccatgtgcccttcggaattagggatagaaacaaatattgtgtgctcttaacgattaagctgtgttatggtgggttttcaggtttttaccttttttctttacccctttactctgcaagaatggggaaagaatgcatactgcgaaaatgagtcttttaaattctgtctgcctactagttttaagtatatggtatgttgtaaaatttccaatgatgagagacagcacaataaatgtaccttatctccttaggctgaaggccataactacatagtggagtaatttaagaactctcttgccttcaccaacccaaaaggttgctttttgatagcaactggctaatgaatttttaaaaagagaagaaaaatactagttttcccctcttttgggaaatagattttaaatggctaaactactagccttaaaactactagtctaataaaatcaactaccacttttgtgaatctgacaggccacatttttatatggccctttacagaatggagtgtgttgaacaggatactaacgccattgagttgagctggcctagcgatggagggacactctaacacaactttccctcagctattatgcaacagatcagggaaaaagatgggatgacagatggggtcagacagaaagagcttctgggaaacaagcttacatagtcttttttaaaatgcacaaagcctcccagctaagaggtcacttggtttgggcttcattaggactgagactttgttgagttctttctgggacttggagagtggatgatattcaggctctgaacattcccagcgctctcccgagggtgccactttctcaagatgaaaactgtgactgaaaaaattaataataaatgtttctgagctgcctgtgttctccctgtgtgggtgagagaagggactagactcctaagcctgcctcagatacaagaggcatcattggctccaattttagagaacttgaaagcaaggctttggacaaaattttgagaccctaatcactttaccttcctccaaattacccaacatacggtaaacaacatttgtgcagaagtatgtatgtatttagttcaggttgacttgtgtccttataaactcttactcaaatgatttgaacttttatgcgactgggattttttttttccaaagctacaagcatggccgcctgtggtatcgaggtgttgcaaacaatatctgtgttgcgcttcctgttttaacctacctcgttttgtttgtttttgtttcactgttcatcacagcagtgttatctccaggagacatatagagagctcaaccggcaatctcaggtgcatttaacatttttaaaacgaaacagtagttgaccaaatttttcttcttaaaaaattggaagtggggggaatccaatgacaaaaactaatgtggcttgtttctggagaaaataattactgtaaatggaacaacaacaacaaaaaaaactacgatcttactgactttgcctaaatacacaagcagctgatgtactattaatgagaacgaaatacacattaggaaaatggagccatttcaatctagtggtttgggcaagatggggaagagaaggggaaacattctagtttctggattacattattatgcccctcctgaaaaggtggttgtcatttgcatttatttaaagcaggtaatatgcaggaatgtaactgaggattatcttcaggcaatcagcaagatatcctcctcatggtccctttagctctcaaaagcaatgaaatcctcctgttctcatttttactgctgtggttgtgctgctgaacaatactatcttctcaaattccatgccacaaattcagcaataactttttggattgaatttaacaactactgtaattggatgctgatgtggacaaaatatattgatttcgatttcactcccgaatgtgattgccaccagctctttatattgctgctgtggtattttaaaccagaagcttctttaaattatgttgcaaactgatctttgtttttatgttttgttttgtttttatttctaagtgataagtttgaaacacacagctttaaatgatttttttattgtgggattttgggtacagttaagaaataaaagggaatcattgtgtttaaacataaggtagtttgtgaatgtattttttaaaatctagagtcattgaaacaaatcataagaaaacaatattaatgcagtcttgtttacagtatgtacagtgacataacatagaacatgagcttttctggtgccaacaacaataaaacacacgttaaacatcaa

SEQ ID NO: 191834 - DNA, 1128 bp, Homo sapiens
  Payload ID: 17907
  Gene Name: TRAF2 and NCK interacting kinase
  ENST ID: ENST00000468757
  CDS Start-End: 77-1128
tattgctagaccaccttgcttggaattaaaagttacacagttatttttcccagaacatgtattttcagcttaaggaatgtcagttagtctttctaaactgggtttcattaagcatctaagctctacagaagatgatttgagagactgccttctcagttcttccaaggagggtacagaggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagca

SEQ ID NO: 191835 - DNA, 3807 bp, Homo sapiens
  Payload ID: 17907
  Gene Name: TRAF2 and NCK interacting kinase
  Uniprot ID: Q9UKE5
  ENST ID: ENST00000475336
  CDS Start-End: 1-3807
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 191836 - DNA, 3918 bp, Homo sapiens
  Payload ID: 17907
  Gene Name: TRAF2 and NCK interacting kinase
  Uniprot ID: Q9UKE5
  ENST ID: ENST00000488470
  CDS Start-End: 1-3918
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctagctacaaaaaagctatagatgaggatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 191837 - DNA, 3894 bp, Homo sapiens
  Payload ID: 17907
  Gene Name: TRAF2 and NCK interacting kinase
  Uniprot ID: Q9UKE5
  ENST ID: ENST00000460047
  CDS Start-End: 1-3894
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatacatcaggcgacagttagaggaggagcagagacagttagagatcttgcagcagcagctactgcatgaacaagctctacttctggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 191838 - DNA, 750 bp, Homo sapiens
  Payload ID: 17907
  Gene Name: TRAF2 and NCK interacting kinase
  ENST ID: ENST00000465393
  CDS Start-End: 343-480
ataacagccaatgcagccgccatccacgcacaagcaaagaagcatgtcccatttaaatacacccacgcagccccagcgcccttagccgatcggggcgctcagcccacacgcaccgctgctcggggcttggagatccgcgcaggctgggctcccggacccggcggaccgacgcgcggaggatcgggatccggcgctgtggggctggggtgggcgggggaggctgggcccggggcctctggcgcgacacccgcatgaggacgcgagtgaaatagaccaaggtggaatttccaagggaaaagcttcggggtggttttggtccatttctccagcgaagaagtagacatggcgagcgactccccggctcgaagcctggatgaaatagatctctcggctctgagggaccccgcagggatctttgaattggtggaacttgttggaaatggaacatacgggcaagtttataagcaaatgaaccagtgagtgaagggcattatcacaactccaagaaccaactaggagtcacccatgacatcatctcctgaatttcatcaccaagcccagctgatcctatttcctaaatggttcctgatttctctcttctgttttctgtctctgccaccactgtcctagcacaggcattgcacatctctcatatgaacgcctgcaggactgtcccttgatgttatccttgcagcccctacattcctactgtgcagccagtaaagtcatattaaaatgcttatttgatca

SEQ ID NO: 191839 - DNA, 3972 bp, Homo sapiens
  Payload ID: 17907
  Gene Name: TRAF2 and NCK interacting kinase
  Uniprot ID: Q9UKE5
  ENST ID: ENST00000470834
  CDS Start-End: 1-3972
atggcgagcgactccccggctcgaagcctggatgaaatagatctctcggctctgagggaccccgcagggatctttgaattggtggaacttgttggaaatggaacatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttggttggtgatggagttttgtggtgctggctctgtcaccgacctgatcaagaacacaaaaggtaacacgttgaaagaggagtggattgcatacatctgcagggaaatcttacgggggctgagtcacctgcaccagcataaagtgattcatcgagatattaaagggcaaaatgtcttgctgactgaaaatgcagaagttaaactagtggactttggagtcagtgctcagcttgatcgaacagtgggcaggaggaatactttcattggaactccctactggatggcaccagaagttattgcctgtgatgaaaacccagatgccacatatgatttcaagagtgacttgtggtctttgggtatcaccgccattgaaatggcagaaggtgctccccctctctgtgacatgcaccccatgagagctctcttcctcatcccccggaacccagcgcctcggctgaagtctaagaagtggtcaaaaaaattccagtcatttattgagagctgcttggtaaagaatcacagccagcgaccagcaacagaacaattgatgaagcatccatttatacgagaccaacctaatgagcgacaggtccgcattcaactcaaggaccatattgatagaacaaagaagaagcgaggagaaaaagatgagacagagtatgagtacagtggaagtgaggaagaagaggaggagaatgactcaggagagcccagctccatcctgaatctgccaggggagtcgacgctgcggagggactttctgaggctgcagctggccaacaaggagcgttctgaggccctacggaggcagcagctggagcagcagcagcgggagaatgaggagcacaagcggcagctgctggccgagcgtcagaagcgcatcgaggagcagaaagagcagaggcggcggctggaggagcaacaaaggcgagagaaggagctgcggaagcagcaggagagggagcagcgccggcactatgaggagcagatgcgccgggaggaggagaggaggcgtgcggagcatgaacaggaatataagcgcaaacaattggaagaacagagacaagcagaaagactgcagaggcagctaaagcaagaaagagactacttagtttcccttcagcatcagcggcaggagcagaggcctgtggagaagaagccactgtaccattacaaagaaggaatgagtcctagtgagaagccagcatgggccaaggaggtagaagaacggtcaaggctcaaccggcaaagttcccctgccatgcctcacaaggttgccaacaggatatctgaccccaacctgcccccaaggtcggagtccttcagcattagtggagttcagcctgctcgaacaccccccatgctcagaccagtcgatccccagatcccacatctggtagctgtaaaatcccagggacctgccttgaccgcctcccagtcagtgcacgagcagcccacaaagggcctctctgggtttcaggaggctctgaacgtgacctcccaccgcgtggagatgccacgccagaactcagatcccacctcggaaaatcctcctctccccactcgcattgaaaagtttgaccgaagctcttggttacgacaggaagaagacattccaccaaaggtgcctcaaagaacaacttctatatccccagcattagccagaaagaattctcctgggaatggtagtgctctgggacccagactaggatctcaacccatcagagcaagcaaccctgatctccggagaactgagcccatcttggagagccccttgcagaggaccagcagtggcagttcctccagctccagcacccctagctcccagcccagctcccaaggaggctcccagcctggatcacaagcaggatccagtgaacgcaccagagttcgagccaacagtaagtcagaaggatcacctgtgctcccccatgagcctgcgaaggtgaaaccagaagaatccagggacattacccggcccagtcgaccagctgatctgacggcattagccaaagaactaagagaactccggattgaagaaacaaaccgcccaatgaagaaggtgactgattactcctcctccagtgaggagtcagaaagtagcgaggaagaggaggaagatggagagagcgagacccatgatgggacagtggctgtcagcgacatacccagactgataccaacaggagctccaggcagcaacgagcagtacaatgtgggaatggtggggacgcatgggctggagacctctcatgcggacagtttcagcggcagtatttcaagagaaggaaccttgatgattagagagacgtctggagagaagaagcgatctggccacagtgacagcaatggctttgctggccacatcaacctccctgacctggtgcagcagagccattctccagctggaaccccgactgagggactggggcgcgtctcaacccattcccaggagatggactctgggactgaatatggcatggggagcagcaccaaagcctccttcaccccctttgtggaccccagagtataccagacgtctcccactgatgaagatgaagaggatgaggaatcatcagccgcagctctgtttactagcgaacttcttaggcaagaacaggccaaactcaatgaagcaagaaagatttcggtggtaaatgtaaacccaaccaacattcggcctcatagcgacacaccagaaatcagaaaatacaagaaacgattcaactcagaaatactttgtgcagctctgtggggtgtaaaccttctggtggggactgaaaatggcctgatgcttttggaccgaagtgggcaaggcaaagtctataatctgatcaaccggaggcgatttcagcagatggatgtgctagagggactgaatgtccttgtgacaatttcaggaaagaagaataagctacgagtttactatctttcatggttaagaaacagaatactacataatgacccagaagtagaaaagaaacaaggctggatcactgttggggacttggaaggctgtatacattataaagttgttaaatatgaaaggatcaaatttttggtgattgccttaaagaatgctgtggaaatatatgcttgggctcctaaaccgtatcataaattcatggcatttaagtcttttgcagatctccagcacaagcctctgctagttgatctcacggtagaagaaggtcaaagattaaaggttatttttggttcacacactggtttccatgtaattgatgttgattcaggaaactcttatgatatctacataccatctcatattcagggcaatatcactcctcatgctattgtcatcttgcctaaaacagatggaatggaaatgcttgtttgctatgaggatgagggggtgtatgtaaacacctatggccggataactaaggatgtggtgctccaatggggagaaatgcccacgtctgtggcctacattcattccaatcagataatgggctggggcgagaaagctattgagatccggtcagtggaaacaggacatttggatggagtatttatgcataagcgagctcaaaggttaaagtttctatgtgaaagaaatgataaggtattttttgcatccgtgcgatctggaggaagtagccaagtgtttttcatgaccctcaacagaaattccatgatgaactggtaa

SEQ ID NO: 191840 - DNA, 2785 bp, Homo sapiens
  Payload ID: 17908
  Gene Name: TRAF3 interacting protein 2
  Uniprot ID: O43734
  ENST ID: ENST00000340026
  CDS Start-End: 596-2320
cggcaatgctgatgttttaagcagttagaggaggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagcctcatctgtatcctcttgtgatggcgtgaaggaaagccatggcagatttccagcctggtgatgctgtacagaacacaggtggcctgcttccatgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaa

SEQ ID NO: 191841 - DNA, 2264 bp, Homo sapiens
  Payload ID: 17908
  Gene Name: TRAF3 interacting protein 2
  Uniprot ID: O43734
  ENST ID: ENST00000359831
  CDS Start-End: 105-1799
tacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaa

SEQ ID NO: 191842 - DNA, 903 bp, Homo sapiens
  Payload ID: 17908
  Gene Name: TRAF3 interacting protein 2
  Uniprot ID: O43734
  ENST ID: ENST00000368735
  CDS Start-End: 155-484
ataggaaagaaggaaatgaaggcggagagtggggagagagcagcagaattcaatttaatctgaggccaccccaagtgttttgtagaattgggctgaagaggtttcctaggcagcctcgcaggctgcacagcacaccacccccgagaagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcaga

SEQ ID NO: 191843 - DNA, 5128 bp, Homo sapiens
  Payload ID: 17908
  Gene Name: TRAF3 interacting protein 2
  Uniprot ID: O43734
  ENST ID: ENST00000368761
  CDS Start-End: 480-2177
ggtggaagaagctcgactccctcttcttccccattatctgcccacaatcccctcctttggagctgctaatgattactaattcttaacattcgagttcaatctcctcccggagacaccctcccaggcgagggcactgcgactacactgaggttctgcccactcctgggcagcttcttagctgggtggcgaaaacaaaaatgccgcctaattggtcactggccctttctcatgaatgaaggaggtttctgttttaagaaataaagtgactcctcagccgttgattcactgcccacagggagattttgagcagaggcttcctaggctccgtagaaatttgcatacagcttccacttcctgcttcagagcctgttcttctacttacctgggcccggagaaggtggagggagacgagaagccgccgagagccgactaccctccgggcccagtctgtctgtccgtggtggatctaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgtaagattatgttttacttatctcaaaggagatacatataatttataatgatatgggcagttgcttccagggacatcaacaaagctgcttagatataatattagataaatataacagaccactctgtattaatggattaaagccagctagttaaacaaccctttttaaccataatcatggaagctttattcttgcaataaagatttttaggctgggcgcagtgactcacacctgtaatcccagcactttgggaagctaaggcaggcagatcatttgaggtcaggagtttgagaccagcctggccaacatggtgaaaccccatctctgctaaaattacaaaaaagttagccgggcatggtggtgtgcacctgtaatcccagctactcgggaggctgaggcaggagaatcacttgaacccgggaggcagaggttgcagtgagccgagatcatgtcactgcactctagcttgggagacagagcgagactccgtctcaaaaaacaaacaaacaaataaaaacacccatttttaacaaaacaactttatatagcatacagccatgattctaaatagtatgattatggttctcaggatctgactacataggtaaaaatatttgcatatgtgtatgaagtgttgggggatgtaggctagaattgtagtctgtgttctaattttggttctaccaccaattagctgtatgacctttagcaagtcctttaacttttcttagattccagggactcatttataaaatgacatggacaaaagcatctctaatcactctaaaagatttgaagtctaggacctaaattctaaatactcttttgaggagtgactgagttttcattttcataattatgtctctcagaggacaaatttacattttcttaacagagacattttcttcttctttttttttgtttgagacagagtctcgctctgtcgtccaggctggagtgcagtgctgcaatcttggctcactgcaacctgcgcctcctgggttcaagtgattcttctgcctcaacctcccaagtagctagacctataggcgcctgccaccatgcccagctaatttttgtatttttagtagagacagggtttcatattggccagactggtctcgaactcctgaccttgtgatccgcccacctcggcctcccaaagtgctgggattacaggtgtgagccaccacacccagccaacattttcctcttttaaaaaatatcttctcacgcctgtaatcccagcactttgggaggctgaggcaggcggatcatgaggtcaggagatcaagaccatcctggctaacacggtgaaactccatctctactaaaaatacaaaaaaaatagccgggcgtggtggcaggcgcctgtagtcccagctactggggaggctgaggcaggaaaatggtgtcaacccgggaggcggagcttgcagtgagccgagattgcgccactgcactccagcctgggcaatagagtgagactccgtctcaaaaaaaaaaaaaaaaaaaaaaacttcaacaataccctcaggttgataattttggatatctatctgtatctatatatcttgtttacctggtctccagaaaaagaacacatacacatatccatatataaaatatgtatacatgtatcaaatctacgtaaactataaaggtgggatggctttaattatggcccaagctactaagacaatgaagactttttggggctgcaagctactgcttcccttctttatctactagcctcttaaacaaggctcacttgtgctacaagacagtccaccgttttgttttttttttcttttttttgagacagggtctcactctttcccaggctgcagtacagtgacacagtctcagctcactgcagctttgaccttgccgggctcaggtgacccttacacttcagcctcccaagtagcagggactataggtgtgcaccaacatgcttggttaatttttgtattttttgtagagacagggttttgccatgttgtccaggctagtctcgaattcctgggctcaagtgattcacctgccttggcctcccaaagtgctaggattacagatgggagccaccacgcccagcccagtccagctcttatatgtagcacagggaaaggacaaatacttgtcaactataaataagaaacattgctaatgcattgcaaagaacactagtttcatttactttataacttagatgtctactgggtgagacgaatgtctttgttctttaaaaaataggaaaagagaagaaaaactagcataacataagtactcatttgtaagactttctgacatgtaacattagttccgtagttttgagacctggtagaactgactttcatatttggataacctggaaaacacccaaacacaaacttcaagtcttctttctcttttttcattatcttttttagtctgaggtgacaccatcattaaggattcgacacccgtttgtaaataaaatgacatcag

SEQ ID NO: 191844 - DNA, 2188 bp, Homo sapiens
  Payload ID: 17908
  Gene Name: TRAF3 interacting protein 2
  Uniprot ID: O43734
  ENST ID: ENST00000392556
  CDS Start-End: 1-1725
atgcctcctcagcttcaagaaactagaatgaaccgaagcattcctgtggaggttgatgaatcagaaccatacccaagtcagttgctgaaaccaatcccagaatattccccggaagaggaatcagaaccacctgctccaaatataaggaacatggcacccaacagcttgtctgcacccacaatgcttcacaattcctccggagacttttctcaagctcactcaaccctgaaacttgcaaatcaccagcggcctgtatcccggcaggtcacctgcctgcgcactcaagttctggaggacagtgaagacagtttctgcaggagacacccaggcctgggcaaagctttcccttctgggtgctctgcagtcagcgagcctgcgtctgagtctgtggttggagccctccctgcagagcatcagttttcatttatggaaaaacgtaatcaatggctggtatctcagctttcagcggcttctcctgacactggccatgactcagacaaatcagaccaaagtttacctaatgcctcagcagactccttgggcggtagccaggagatggtgcaacggccccagcctcacaggaaccgagcaggcctggatctgccaaccatagacacgggatatgattcccagccccaggatgtcctgggcatcaggcagctggaaaggcccctgcccctcacctccgtgtgttacccccaggacctccccagacctctcaggtccagggagttccctcagtttgaacctcagaggtatccagcatgtgcacagatgctgcctcccaatctttccccacatgctccatggaactatcattaccattgtcctggaagtcccgatcaccaggtgccatatggccatgactaccctcgagcagcctaccagcaagtgatccagccggctctgcctgggcagcccctgcctggagccagtgtgagaggcctgcaccctgtgcagaaggttatcctgaattatcccagcccctgggaccacgaagagaggcccgcacagagagactgctcctttccggggcttccaaggcaccaggaccagccacatcaccagccacctaatagagctggtgctcctggggagtccttggagtgccctgcagagctgagaccacaggttccccagcctccgtccccagctgctgtgcctagaccccctagcaaccctccagccagaggaactctaaaaacaagcaatttgccagaagaattgcggaaagtctttatcacttattcgatggacacagctatggaggtggtgaaattcgtgaactttttgttggtaaatggcttccaaactgcaattgacatatttgaggatagaatccgaggcattgatatcattaaatggatggagcgctaccttagggataagaccgtgatgataatcgtagcaatcagccccaaatacaaacaggacgtggaaggcgctgagtcgcagctggacgaggatgagcatggcttacatactaagtacattcatcgaatgatgcagattgagttcataaaacaaggaagcatgaatttcagattcatccctgtgctcttcccaaatgctaagaaggagcatgtgcccacctggcttcagaacactcatgtctacagctggcccaagaataaaaaaaacatcctgctgcggctgctgagagaggaagagtatgtggctcctccacgggggcctctgcccacccttcaggtggttcccttgtgacaccgttcatccccagatcactgaggccaggccatgtttggggccttgttctgacagcattctggctgaggctggtcggtagcactcctggctggtttttttctgttcctccccgagaggccctctggcccccaggaaacctgttgtgcagagctcttccccggagacctccacacaccctggctttgaagtggagtctgtgactgctctgcattctctgcttttaaaaaaaccattgcaggtgccagtgtcccatatgttcctcctgacagtttgatgtgtccattctgggcctctcagtgcttagcaagtagataatgtaagggatgtggcagcaaatggaaatgactacaaacactctcctatcaatcacttcaggctacttttatgagttagccagatgcttgtgtatcctcagaccaaactgattcatgtacaaataataaaatgtttactcttttgt

SEQ ID NO: 191845 - DNA, 1065 bp, Homo sapiens
  Payload ID: 17909
  Gene Name: TRAF3 interacting protein 3
  ENST ID: ENST00000367023
  CDS Start-End: 264-812
gagatgacagcgcagcggggattggctgaagccctaagcaacctctactagagcagagagatgagctgtgggctggtgcttctgtggtgaggtggtggtgtttctggagagcagatcagaggcaggggaaaaccacgcagaagcaggagctgaagacctcagaccggcaccagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcagg

SEQ ID NO: 191846 - DNA, 2331 bp, Homo sapiens
  Payload ID: 17909
  Gene Name: TRAF3 interacting protein 3
  Uniprot ID: Q9Y228
  ENST ID: ENST00000367024
  CDS Start-End: 517-2172
agagaattccagactgagccagagtagcgaagtcccagtaaaggggcagagagtctgctacctgttgagtctgtttggcctataaataaaccccaaggggttagagctagcaaatgcctgctagttggtgaagctgagataccctcctcccagggtggtgggtaatgaggtcgtgggaggaagagaagcagcagcagctgtgagggggagtccctcttccttcatcagtccctggtctgactccagtgatcagaggaggcaggacacagaatttccaacgctcaggatccagctcatccaaatccagcccaactcagcaaagtgaccagagggttctaggaggataaactacagaagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgacc

SEQ ID NO: 191847 - DNA, 2243 bp, Homo sapiens
  Payload ID: 17909
  Gene Name: TRAF3 interacting protein 3
  Uniprot ID: Q9Y228
  ENST ID: ENST00000367025
  CDS Start-End: 421-2076
acttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgtt

SEQ ID NO: 191848 - DNA, 2058 bp, Homo sapiens
  Payload ID: 17909
  Gene Name: TRAF3 interacting protein 3
  Uniprot ID: Q9Y228
  ENST ID: ENST00000367026
  CDS Start-End: 291-1886
gcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctca

SEQ ID NO: 191849 - DNA, 1854 bp, Homo sapiens
  Payload ID: 17909
  Gene Name: TRAF3 interacting protein 3
  ENST ID: ENST00000400959
  CDS Start-End: 438-1652
tcagagttcaggggcccacttagatgataccagagagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcaggaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcag

SEQ ID NO: 191850 - DNA, 791 bp, Homo sapiens
  Payload ID: 17909
  Gene Name: TRAF3 interacting protein 3
  ENST ID: ENST00000477431
  CDS Start-End: 137-607
gaaaaccacgcagaagcaggagctgaagacctcagaccggcaccagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattg

SEQ ID NO: 191851 - DNA, 1860 bp, Homo sapiens
  Payload ID: 17909
  Gene Name: TRAF3 interacting protein 3
  Uniprot ID: Q9Y228
  ENST ID: ENST00000478359
  CDS Start-End: 404-1465
gagcaagagagaggaactggggtttgcgaaccttgtggctttgtctgtttcctgtttcagcaaggctgctgtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgactgtcctcaaggaacccttgtcttgtgccagaaggatttcttctcccagagagcaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagatcaactaaaaaggtcagaggcagagaaactcaccctggtgaccagagtacagcagttgcagggtttgcttcaaaatcaatccttacagcttcaagaacaggagaaactcttaacaaagaaaggtcagcaaatttattaccacaaattctaagatattgctcttctcttacctgcctagaggcagcgggatggactacatgacctcctggagtcccagccagttctgggagtctgttaagtccgggatgtgtgggagctttttaaggactgatcattggctctgaggacacttcaactagttagccttctatcttgaggtatataaactgtgaaaaagggtttctattctctctgaaagcacatgtctgtgttgaacatttcaataaatttattttgaactcag

SEQ ID NO: 191852 - DNA, 499 bp, Homo sapiens
  Payload ID: 17909
  Gene Name: TRAF3 interacting protein 3
  ENST ID: ENST00000487271
  CDS Start-End: 206-499
agaggcaggggaaaaccacgcagaagcaggagctgaagacctcagaccggcaccagggacagcttaatgaagacaaactgaaggggaaactgagatccttagaaaaccagctatacacctgtacccagctcaggatttggcacacagaagctcaatgtgtatttgttgaattgcatcaaatttacagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccag

SEQ ID NO: 191853 - DNA, 540 bp, Homo sapiens
  Payload ID: 17909
  Gene Name: TRAF3 interacting protein 3
  ENST ID: ENST00000479796
  CDS Start-End: 463-540
gtgcaaaaagaaagacggtaccaagaagggacgtgttaatggggcccagacctatggattgaaagcgtgtgctttacccatctgctgtcttgctccatctgagaccagagccaagatctgcccaggactggaatgctttcccgagtggcttgagttggagcctgggactaggagtccctggtctgactccagtgatcagaggaggcaggacacagaatttccaacgctcaggatccagctcatccaaatccagcccaactcagcaaagtgaccagagggttctaggaggataaactacagaagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcagg

SEQ ID NO: 191854 - DNA, 551 bp, Homo sapiens
  Payload ID: 17909
  Gene Name: TRAF3 interacting protein 3
  ENST ID: ENST00000471368
  CDS Start-End: 1-210
ctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctca

SEQ ID NO: 191855 - DNA, 811 bp, Homo sapiens
  Payload ID: 17910
  Gene Name: trafficking protein particle complex 1
  Uniprot ID: Q9Y5R8
  ENST ID: ENST00000303731
  CDS Start-End: 117-554
gttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctc

SEQ ID NO: 191856 - DNA, 759 bp, Homo sapiens
  Payload ID: 17910
  Gene Name: trafficking protein particle complex 1
  Uniprot ID: Q9Y5R8
  ENST ID: ENST00000540486
  CDS Start-End: 61-498
aaggggcggagctccgtggaaaccggaagtaactcttgacgggcactcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctctgcg

SEQ ID NO: 191857 - DNA, 648 bp, Homo sapiens
  Payload ID: 17910
  Gene Name: trafficking protein particle complex 1
  ENST ID: ENST00000571739
  CDS Start-End: 24-152
gacgggcactcggagcagttccgatgactgtccacaacctgtacctgtttgaccggaatggagtgtgtctgcactacagcgaatggcaccgcaagaagcaagcagggattcccaaggaggaggaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctct

SEQ ID NO: 191858 - DNA, 306 bp, Homo sapiens
  Payload ID: 17910
  Gene Name: trafficking protein particle complex 1
  ENST ID: ENST00000571947
  CDS Start-End: 22-306
gcagttccggtgagtccgtggatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagat

SEQ ID NO: 191859 - DNA, 561 bp, Homo sapiens
  Payload ID: 17910
  Gene Name: trafficking protein particle complex 1
  ENST ID: ENST00000575639
  CDS Start-End: 93-221
tccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccacccc

SEQ ID NO: 191860 - DNA, 409 bp, Homo sapiens
  Payload ID: 17910
  Gene Name: trafficking protein particle complex 1
  ENST ID: ENST00000572656
  CDS Start-End: 185-409
cgagcgcctggccgcgcgtgcgcggctccggtggccacagattggctgagggagggaggcggagtctgacaagcagcactggagcggagttaatgcccagccgcggccgagcgagaacccccctaaggggcggagctccgtggaaaccggaagtaactcttgacgggcactcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgag

SEQ ID NO: 191861 - DNA, 6976 bp, Homo sapiens
  Payload ID: 17911
  Gene Name: trafficking protein particle complex 10
  Uniprot ID: P48553
  ENST ID: ENST00000291574
  CDS Start-End: 176-3955
ccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctgaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggaaggtcagatcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttacaaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaa

SEQ ID NO: 191862 - DNA, 1763 bp, Homo sapiens
  Payload ID: 17911
  Gene Name: trafficking protein particle complex 10
  Uniprot ID: P48553
  ENST ID: ENST00000380221
  CDS Start-End: 176-1006
ccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccgggggtataaaatgtcctttccacaactcagtggcctgctggtgatgcttcgattctgtccctcgttagaatcagagtggacgtccctttgccttccatccaggggttatctttggaatgctcgagtgctcattgctgtgaacttataaaatgcccttgggtgttcatctttcttttgcacttttaaataatatcttaagctcctttacaattaaagaattagcacagtgaaaccatacacagagagaaacattggttattgtcctcagtgtttttcgctgatacttattttgatgaaagtgataccacgttatatagctgtttctctgtcgctcctttttgttactcacagcccatcctgggcatctctccaggttagcaggtggggtttggagttgtttttgttacaattggtattcctggcttgattccattacctggtgttggacattgggttcttttatgcttcttgccaccacaagcagtgctgtagtgggcatctctgccaggtgttctttttgagaacccttgtcaccatgtgtgaaggaaggagtaattttgaggagccctggtgtcagcaggagaacctggagggagatgaagtgtggggacggtcagttctagctgtgagcactgtcctcactctggaactcatcagtggcgccgatggatactggctcatagtgcttctgaagatcaggtctggatatctcactctcctgagatgccagtatagacacagaaccaaagcaaagtgtttactaagtaaaaaaataaaataaaaaaacacttctatttctta

SEQ ID NO: 191863 - DNA, 5267 bp, Homo sapiens
  Payload ID: 17911
  Gene Name: trafficking protein particle complex 10
  ENST ID: ENST00000422875
  CDS Start-End: 170-967
gtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccgggggagcttgactcagggacgtgacgtggttgagttagggaaataaggaaggaatatgtaatctaaggaagaccaaaaaacaccaggatggtcagagcaggctgcactccagcccacagatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaa

SEQ ID NO: 191864 - DNA, 4552 bp, Homo sapiens
  Payload ID: 17912
  Gene Name: trafficking protein particle complex 11
  Uniprot ID: Q7Z392
  ENST ID: ENST00000334690
  CDS Start-End: 203-3604
aaagtgcttcctgtgccgggggaggtgggtacagggaagtctcgcctgttggaactggctgtggggctgcggcggtggggacgggccacggcgttctgtgacatccccccgcctcccctcgtcttctcccggctggcggcgaccggcctcagctgcagcgggcccggggcgtggggcctgggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggcaaagtttacaaggaagaaacacaaaagttgcagtggttctgattcagaagaaaacccctttgcccccaggagaagatgtcattgcttcagaaagggctgcagctttatgcaatgcatgtgaactctcaggaaagtctttgtttgtactgccgcacactgaccaccttgtgggttatattataagattggaaaatgccttttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcagagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagta

SEQ ID NO: 191865 - DNA, 4435 bp, Homo sapiens
  Payload ID: 17912
  Gene Name: trafficking protein particle complex 11
  Uniprot ID: Q7Z392
  ENST ID: ENST00000357207
  CDS Start-End: 203-3463
aaagtgcttcctgtgccgggggaggtgggtacagggaagtctcgcctgttggaactggctgtggggctgcggcggtggggacgggccacggcgttctgtgacatccccccgcctcccctcgtcttctcccggctggcggcgaccggcctcagctgcagcgggcccggggcgtggggcctgggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaaggtgctcccaggtgaccatgagtatcccaaatgtagacccaagagaacttcatatgagtggtacattcctaaagggatcttaaagactggctggatgaataagcatctgaatctggtgccagccctggtggttgtgttctatgaactggactgggatgagcctcagtggaaagaaaagcagtctgagtgcgccaccagagtggaaatagtcaggcaaagtttacaaggaagaaacacaaaagttgcagtggttctgattcagaagaaaacccctttgcccccaggagaagatgtcattgcttcagaaagggctgcagctttatgcaatgcatgtgaactctcaggaaagtctttgtttgtactgccgcacactgaccaccttgtgggttatattataagattggaaaatgccttttatgaacatgcacagacttattactacactgagatcagaagagtgaaatctcataaagaatttttgaataaaacaacacaccagcttttatttgttaggcatcagttcaaaatagctttcttcagtgagttgaaacaagatacacaaaatgcgctgaagaattataggaccgcctataatcttgtacacgaattgagagcccatgaaactaatattctggaaattaagactatggcaggatttataaactacaagatctgtaggctgtgttttcaacacaacaccccattggatgcaattgctcagttccgaaaacacatcgacttgtgtaagaaaaagattggaagtgcagagctgtcttttgagcatgatgcatggatgtctaaacaattccaggcctttggagatttatttgatgaagctattaagttagggttaacagctattcaaactcagaatcctggtttctattaccagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccgaatcccccatgtgtctctttcagagctggccagaccggaaataaatcattctcataaattcagtgtgtactcagaacacatacacaacaacatagggagttgtatgactgatacggaaaacttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcagggtctgagtcaggccttctggttatattgtgcagtttcaaaagaactatttaaaactcttgaaaactcatgtaaataaaaatcatagggtgaaaattgtatttgttaaaataccttaataatttaaaatgacctgatttcctggaaaattttattattcaaaaggtggaggcattgtaaaaaggaaatagtgatgtaaataaacatgttctctttcaagtatg

SEQ ID NO: 191866 - DNA, 2546 bp, Homo sapiens
  Payload ID: 17912
  Gene Name: trafficking protein particle complex 11
  ENST ID: ENST00000512476
  CDS Start-End: 102-2321
agaatgttgaagagtctgaaatgattatattaaataaaggtttcaaggagtgtacacatacaacgttcatatgaagatttatattaaatgagctgtctaaaatgagttgtgtctcatcttacgcaggttttgatctttctgatcctgaaaaagaaaaggtgggaattcttgccattcagctgaaggagagaaatgttgttcactctgagataatcataactcttctgagcaatgctgttgcacagttcaagaagtataagtgcccgcgaatgaaaagtcacctaatggttcagatgggagaggaatattattacgcaaaggattataccaaagctttgaagttgctggattatgtgatgtgtgattatcggagtgaaggatggtggactctgctcacttctgtattaactacagctctgaagtgctcctacctcatggcccaattaaaggattacattacttactccctagaactccttggtagagcttcaactctgaaagatgaccagaagtctcggatagaaaagaacctcataaatgttttaatgaatgaaagtcctgatccagaacccgactgtgatatcttagctgtgaaaactgctcagaagctgtgggcagaccgaatttctctggctggcagcaatattttcacaataggagtacaggactttgtgccatttgtgcagtgcaaagccaagtttcatgccccaagttttcatgttgatgttcctgttcagtttgatatttatctgaaggctgattgtccacatcccattaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacgtatcctccctggcacggagcaggaaatgctatataatttctatcctctgatggctggataccagcagctgccatctctcaacatcaacttgcttagatttcctaacttcacaaatcagctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaa

SEQ ID NO: 191867 - DNA, 2244 bp, Homo sapiens
  Payload ID: 17912
  Gene Name: trafficking protein particle complex 11
  ENST ID: ENST00000505676
  CDS Start-End: 94-468
cgcctcccctcgtcttctcccggctggcggcgaccggcctcagctgcagcgggcccggggcgtggggcctgggttttttgtgacatcgtaaacatgagccccacacagtgggacttccctgtggaattatgttgccggcctatggcctttgttactctaacgggcctggatgtagtttataatgcagtccatcgagctgtctgggacgccttctgtgcaaatcggagagctgatcgagtaccaatttctttcaagcaggcagcatactatgcccaggagcggaaacagcttgcaaaaaccctctgtaaccacgaagcttctgtaatgtatcccaatcctgatcccttagaaacacaaacaggcgttcttgacttttatggacaaagatcatggcgacaaggaatactaagttttgatctttctgatcctgaaaaagaaaaggttttccaagctctgtgtcagctttaataatcaggaatacaaccagttctgtgtaatagaagaagcatccaaagcaaatgaagttttagaaaatctgactcaaggaaagatgtgcctagttcctggcaaaacaagaaaactgttatttaagtttgttgcaaaaactgaagatgtgggaaagaaaattgagattacttcagtggatcttgctctgggcaatgagacgggaagatgtgtggttttaaattggcagggaggaggaggagatgctgcttcctcccaagaagccttacaggcagctcggtctttcaaaaggcgacctaagctacctgacaatgaagttcactgggacagcattataattcaggcaagcacaatgatcatatccagagtcccaaacatttctgtacatctgctacatgaaccccctgcactgactaatgaaatgtattgtttggttgtgactgttcagtcccatgaaaagacccaaatcagagatgtgaagctcaccgctggcttaaaaccaggacaggatgccaatttaactcagaagactcacgtgactcttcatggaacagaactgtgtgatgaatcctacccggctttactcactgacattcctgttggagacttacatccaggggaacagctggaaaaaatgttgtatgttcgctgtggaacagtgggttccagaatgtttcttgtatatgtttcttacctgataaatacaaccgttgaagaaaaagaaattgtttgcaagtgtcacaaggatgaaactgtaacaattgaaacagtctttccatttgatgttgcggttaaatttgtttctaccaagtttgagcacctggaaagggtttatgctgacatcccctttctgttgatgacggacctcttaagtgcctcaccctgggccctcactattgtttccagtgagctccagcttgctccatccatgaccacagtggaccagctcgagtctcaagtggacaatgttatcttacagactggagagagtgctagtgaatgcttttgtcttcaatgcccatctcttggaaatattgaaggtggagtagcaaccgggcattatattatctcttggaaaaggacctcagcaatggagaatatccccatcatcacaactgtcatcactctgccgcacgtgattgtggagaatatccctctccatgtgaatgcagatctgccgtcatttgggcgtgtcagagagtcgttacctgtcaagtatcacctacagaataagaccgacttagttcaagatgtagaaatttctgtggagcccagtgatgccttcatgttctcaggtctcaaacagattcgattacctgctcaggcgttttatacctaccagtatttttgtcaagccacagggtcgactcatggatgatacctctattgctgctgcatgatgttcaagaccggcccttggctgttgttacagagatgttgggcagagctatgcaggtgtttcattgtgaactctagctttgatcatggtaaaaagttaaccttttctattttttaatggatgttataccaactattcagaggaactcatacttcaaaaatattaggaaaatctgtcttatagtttctctaataaatatctgaaatctcagtacgacatgaaagaatgtcagaccattgttattgttgaaagtcatttgatgaatggtaaattctatgaaaagtaagtgatttgcatgtataatatcaggaaaattaagcatcccaagtgtgactggacaaagagagcagatgcaccagtgcctgtgccataaagttccg

SEQ ID NO: 191868 - DNA, 2508 bp, Homo sapiens
  Payload ID: 17913
  Gene Name: trafficking protein particle complex 12
  Uniprot ID: Q8WVT3
  ENST ID: ENST00000324266
  CDS Start-End: 196-2403
ggggcagggcctcgggttcctgcatcgggcctgagcagaactaggcgcgccgcggcccggcacgcgcaggcgtacagagctccccgggggtgccagttcctctccgattcccggcttctgtcaccttcctcacggaccttggtcacggccgcaggtgaccccttagcccagctccagtgggcgggtggcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactcctttactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgagcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcac

SEQ ID NO: 191869 - DNA, 2483 bp, Homo sapiens
  Payload ID: 17913
  Gene Name: trafficking protein particle complex 12
  Uniprot ID: Q8WVT3
  ENST ID: ENST00000382110
  CDS Start-End: 170-2377
tttccggcctgggggcagggcctcgggttcctgcatcgggcctgagcagaactaggcgcgccgcggcccggcacgcgcaggcgtacagagctccccgggggtgccagttcctctccgattcccggcttctgtcaccttcctcacggaccttggtcacggccgcagggtcatggaggacgctggcggcggcgaggagaccccggccccggaggccccgcacccccctcagctcgcgcctccggaggagcaggggttgctcttccaggaggaaaccatcgatcttggcggagatgagtttggatccgaagagaacgagaccgcatcggaaggctcgagtcctctcgcggacaagctgaacgaacacatgatggagagcgtcctcatctctgactcccccaacagcgagggcgacgcgggcgacctgggccgagtgcgggacgaagctgagcccggaggggaaggcgacccaggcccggagcccgcgggcaccccgagtcccagcggcgaggccgacggcgactgtgcccccgaggacgcggcacccagtagcggaggggccccgaggcaggacgcggcccgcgaggtcccaggcagcgaagccgcgcgcccggagcaggagcctcccgttgcggagccggtcccggtgtgcaccatcttcagccagcgcgcgcccccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactcctttactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgagcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcact

SEQ ID NO: 191870 - DNA, 473 bp, Homo sapiens
  Payload ID: 17913
  Gene Name: trafficking protein particle complex 12
  ENST ID: ENST00000416918
  CDS Start-End: 1-367
gcatcggccggatttccctgcaggtacctgtgcacgcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcact

SEQ ID NO: 191871 - DNA, 544 bp, Homo sapiens
  Payload ID: 17913
  Gene Name: trafficking protein particle complex 12
  ENST ID: ENST00000452495
  CDS Start-End: 1-328
tgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtgcagatgctgtcagcctcgcatcctacaggaaaggaaccatcgccaaaagacgctgaggaacatcccgagggtcacagggacagtgcagagccaggaccagcccggcccatggtcccccagcgtgcaccacctggcccggcactgtgtgctcagccatgaggactgggaagagtcctgcccacagctcaagtgtctacaccgcactgccatccaggctgtgagccgctgctgagcatggggaatgtggctgctgcagagacgttatgaaacacttctaaaagaatgtaaaagatctcattaataattttgagtacctgttaaaatgatagtaattttggatctagtagattaaataaaacatattattaaaattaa

SEQ ID NO: 191872 - DNA, 815 bp, Homo sapiens
  Payload ID: 17913
  Gene Name: trafficking protein particle complex 12
  ENST ID: ENST00000415624
  CDS Start-End: 1-705
aaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactggtg

SEQ ID NO: 191873 - DNA, 698 bp, Homo sapiens
  Payload ID: 17913
  Gene Name: trafficking protein particle complex 12
  ENST ID: ENST00000441099
  CDS Start-End: 1-191
atctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagcaacatggatacagctggaggccattatcctaagtgaattaacacagaaacagaaaaccaaatagtgaatgttttcacatatcctggccaatttggagcaaggcttagcagaagacggcggcatgagcagcgtgactcaggagggcagacaagtcagcactgcacgtgtccactcgtgcatttgcaactcactcctttcttggggaagccaagcacatcactgggtgatgctgtgggtgcaacgtgcagcctcagacccgaaccctgcgcccggggagaagacacgccttcaccacaaaagcacacggcccggaacctgccacgctgagtggtctgagtgggcgcgaggaaggagcccagcccagccgaaggggcccagaggggcctctgcgtcggggagagaggcctctgcgtcggggacagaggcctctgcgtcggggacagaggctcgggagggtgcttcaggaggagctggagaggaaggcccagagcctggggcaggctgagggacctgggcagttccctggagcattggaaacc

SEQ ID NO: 191874 - DNA, 1047 bp, Homo sapiens
  Payload ID: 17913
  Gene Name: trafficking protein particle complex 12
  ENST ID: ENST00000417243
  CDS Start-End: 1-637
ctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcact

SEQ ID NO: 191875 - DNA, 579 bp, Homo sapiens
  Payload ID: 17913
  Gene Name: trafficking protein particle complex 12
  ENST ID: ENST00000457845
  CDS Start-End: 470-579
acagtgttattgctgtcttggtacctgcactccgcggagtcctgagttcttgtcctgcctccaagaagaacgagattatgccgacaaccagagtggagatgcagttaaagacttgatgcttcgctttctgggtgaaaaagctgcagcaaagagacaagtcctaaatgccgactcagtggaacaatcttttgttggattgaaacagctaatccgttgacaaatggcatgcccctccgtgccgtcagcacactgacgttgtcaccattactaacggctggctggcgctgcttccagcaagagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcat

SEQ ID NO: 191876 - DNA, 838 bp, Homo sapiens
  Payload ID: 17913
  Gene Name: trafficking protein particle complex 12
  ENST ID: ENST00000411973
  CDS Start-End: 1-667
cccagcctccggggacggcttcgagccgcagatggtgaagtcgcccagcttcggtggcgccagcgaggcctcggccaggacaccgccccaggtcgtgcagcccagccccagcctcagcacgttcttcggagacacggccgccagccactccttggcctcggacttcttcgactcctttactacctccgccttcatttccgtcagcaatcccggcgcgggctccccggcccccgccagcccgcctcccctcgctgtgcccgggaccgaggggcgccccgaacccgtggccatgcgagggccccaggcagctgcgcccccggcgtcgccagagcctttcgcgcacatccaggcagtgtttgcagggagtgacgacccctttgccaccgccctgagcatgagcgagatggaccggaggaacgacgcctggcttcccggcgaggctacgcgtggagtcctgcgggccgtggccacccagcagcgcggcgccgtgttcgtggacaaggagaacctcaccatgccgggcctcaggttcgacaacatccagggagatgcagttaaagacttgatgcttcgctttctgggtgaaaaagctgcagcaaagagacaagtcctaaatgccgactcagtggaacaatcttttgttggattgaaacagctaatccgttgacaaatggcatgcccctccgtgccgtcagcacactgacgttgtcaccattactaacggctggctggcgctgcttccagcaagagctgcagaaactggagggcagcagtggacctgtgcggacgtctcctcacagcccacggccagggctacggcaagagcgggctgctcacc

SEQ ID NO: 191877 - DNA, 518 bp, Homo sapiens
  Payload ID: 17913
  Gene Name: trafficking protein particle complex 12
  ENST ID: ENST00000437733
  CDS Start-End: 1-168
atgtactccatggcaaactgtctgctcctgatgaagctcgccagtatgcacatcagaacccgccgtggctccgcacatgatggaaaggagcacgcagctgcatcagctaccttccgtcttgctgaaattagactgcagaagtccttgctggttgcagaatggttgtaaatctagtttcacggcctgtaaacacgtgtggctgctgaaaagaaatggtgaagattgagctaaaatagacttgtccctggaagattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaagga

SEQ ID NO: 191878 - DNA, 683 bp, Homo sapiens
  Payload ID: 17913
  Gene Name: trafficking protein particle complex 12
  ENST ID: ENST00000441983
  CDS Start-End: 108-683
attgctgtcttggtacctgcactccgcggagtcctgagttcttgtcctgcctccaagaagaacgagattatgccgacaaccagagtggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatg

SEQ ID NO: 191879 - DNA, 1269 bp, Homo sapiens
  Payload ID: 17913
  Gene Name: trafficking protein particle complex 12
  ENST ID: ENST00000618133
  CDS Start-End: 1-1161
ggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactgg

SEQ ID NO: 191880 - DNA, 1303 bp, Homo sapiens
  Payload ID: 17913
  Gene Name: trafficking protein particle complex 12
  ENST ID: ENST00000628660
  CDS Start-End: 1-1095
ggagatgcagttaaagacttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaaggctgctcttaccttgtagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtgcagatgctgtcagcctcgcatcctacaggaaaggaaccatcgccaaaagacgctgaggaacatcccgagggtcacagggacagtgcagagccaggaccagcccggcccatggtcccccagcgtgcaccacctggcccggcactgtgtgctcagccatgaggactgggaagagtcctgcccacagctcaagtgtctacaccgcactgccatccaggctgtgagccgctgctgagcatggggaatgtggctgctgcagagacgttatgaaacacttctaaaagaatgtaaaagatctcattaataattttgagtacctgttaaaatgatagtaattttggatctagtagattaaataaaacatattatt

SEQ ID NO: 191881 - DNA, 1253 bp, Homo sapiens
  Payload ID: 17913
  Gene Name: trafficking protein particle complex 12
  ENST ID: ENST00000631737
  CDS Start-End: 4-1143
ttgatgcttcgctttctgggtgaaaaagctgcagcaaagagacaagtcctaaatgccgactcagtggaacaatcttttgttggattgaaacagctaatcagctgcagaaactggagggcagcagtggacctgtgcggacgtctcctcacagcccacggccagggctacggcaagagcgggctgctcaccagccacacgacagattcactgcagctctggtttgtcaggctggcactactagtgaagttgggccttttccagaatgctgagatggaatttgaacccttcggaaatcttgatcagccagatctttattacgagtactacccgcacgtgtaccctgggcgcaggggctccatggtccccttctcgatgcgcatcttgcacgcggagcttcagcagtacctggggaacccacaggagtcgctggatagactgcacaaggtgaagactgtctgcagcaagatcctggccaatttggagcaaggcttagcagaagacggcggcatgagcagcgtgactcaggagggcagacaagcctctatccggctgtggaggtcacgtctgggccgggtgatgtactccatggcaaactgtctgctcctgatgaaggattatgtgctggccgtggaggcgtatcattcggttatcaagtattacccagagcaagagccccagctgctcagcggcatcggccggatttccctgcagattggagacataaaaacagctgaaaagtattttcaagacgttgagaaagtaacacagaaattagatggactacagggtaaaatcatggttttgatgaacagcgcgttccttcacctcgggcagaataactttgcagaagcccacaggttcttcacagagatcttaaggatggatccaagaaacgcagtggccaacaacaacgctgccgtgtgtctgctctacctgggcaagctcaaggactccctgcggcagctggaggccatggtccagcaggaccccaggcactacctgcacgagagcgtgctcttcaacctgaccaccatgtacgagctggagtcctcacggagcatgcagaagaaacaggccctgctggaggctgtcgccggcaaggagggggacagcttcaacacacagtgcctcaagctggcctagctgcctccaacacactacgtcagaaggacccgggtctttgaaactgtgtcttgaagctaatgtattaatgtgacatggaggaactcaataaaactcctgcttcactggtg

SEQ ID NO: 191882 - DNA, 2715 bp, Homo sapiens
  Payload ID: 17914
  Gene Name: trafficking protein particle complex 13
  Uniprot ID: A5PLN9
  ENST ID: ENST00000231526
  CDS Start-End: 22-1257
gggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaa

SEQ ID NO: 191883 - DNA, 3221 bp, Homo sapiens
  Payload ID: 17914
  Gene Name: trafficking protein particle complex 13
  Uniprot ID: A5PLN9
  ENST ID: ENST00000399438
  CDS Start-End: 346-1599
tttttttttttttttttttaaaaaaaaaactccggcaacgttggcctttgggaggccgcgtattgttacctaggggtggtttcttttcctgcagtcgcgatgtgtgattgcagatggaaaacaaagtattttatgcctacgtttctaagatagaagaaatggacttgttgaaaagaagccagtttgtaaaggacacagtaggagaatttaaggtaccaccaccagagagaggttgagagtgcgtttgacttttggttttgccaaacgcgaggttttccgtttccttccggggcaagttgaacctgtccagcccccgtaggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagagatctgattttatcttgtaatttatatttgaaatgaacatgtgtatattttctacacctattatttaatttcatttcattttagatgaccattggactttgttctccaaaagctgtgtatctgagaccatttgtccctagcaagttatctagaacacgagtcagcacactttttatgtaaggtacaagatactaaatattttaggctttgcaggccgtaaggtttctgtcacaaatactgaactctgccatcgtacttcaagagcagccagtaggcaaaaaaagtacagtggtgtacacaaaaagaagcagttggactcgggaagctgaggcaggagaatcacttgaaccggggaggcagaggttgcagttaagccgagatcatgctactgcactctagcctgagcgacagagtgagactctgtctcaaaaaaaaagaggcagctgggcagatttggcctgcagggtatagttggctgacctcaatctagaagatagagttgtttcttagaactttgtaatattttggttagaaatatttcagttaactccagttttttcctagctattcggtcagcagaaaaagtttgcttaaaacaaagggggtagtcctcttataacctgatatttgtcaacacagtataagctttctagttgttttcaaaattactgtaatggtttgtgtctgtatttgtatattatacctacaaacatacatatctttcagctactgaacacatcagaattggttttactttttaggttgttgattttttttaattaactattaactaagaataatacttattttctaattataagccaaaaacccctgggtttttttctcattgattaagccacttatttttataaggtatatttaaataattcccatcttctgatatgattttaaactctaaatcatgtgttactgttacaaaactttctctctccatgtaatcacacttagttatgagcaaagcagtgagaaagttgaggtgataaacaactttgcagcattaatgtaacaaaaagtttcagtatttgtcaggaaaacaaaagcttaggctgttaaataaaagctattctattttggtaagttgaaattcaagaatgtatatataatttcttaaatgtaagagtgcattaaatcaaatacaaaaattggtttttcaatgcatcattatttattgccataacaaattgtttggtccaaaatgaaagctatattcagaaggtttgcacctcaaaattgagtaataattaatgaaatgtctgtacaaaataaagtgcaagcagtgtaaaattgaagtctgtctttgtttcaaaatgattaagattaaatgatgaaataatattttatagccactgcattggatacttggattgtttttcaagcatcttcttatgactaaatcttctgtttcattctgttttaaatctaaaaagtaaaatgatggtcacttggaa

SEQ ID NO: 191884 - DNA, 1437 bp, Homo sapiens
  Payload ID: 17914
  Gene Name: trafficking protein particle complex 13
  Uniprot ID: A5PLN9
  ENST ID: ENST00000438419
  CDS Start-End: 28-1284
ggctgtgggtcaaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaaga

SEQ ID NO: 191885 - DNA, 1410 bp, Homo sapiens
  Payload ID: 17914
  Gene Name: trafficking protein particle complex 13
  Uniprot ID: A5PLN9
  ENST ID: ENST00000505553
  CDS Start-End: 17-1255
aaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggaatatatttttgggagagaccttttccagttatatcagcgttcataatgatagcaatcaagttgtaaaagacatattagtaaaagctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagtaacagtaattggaaaattggatatagtatggaaaacaaatctaggtgaaaggggaaggttacagaccagccaacttcaaagaatggctccaggttatggagatgttaggttgtctttggaggcaataccagataccgtaaaccttgaagaaccttttcatattacctgtaaaataacaaactgcagcagtgaaaggactatggatctggttttggaaatgtgcaataccaattccatccactggtgtggaatttcaggaagacagctgggaaagctgcatccaagttcttcgctctgtcttgcccttactctgctttcttcagtacagggactgcaaagcatctctggcttaagactaacagacacattcttaaagagaacatatgaatatgatgacatcgcacaagtctgtgtggtatcttctgccattaaagtggaaagctgaaggaaacttccaatgttaggcttttcatttagtttcacagaactgctctttttgttacctttgtaaaatgatgacgtcaacaacgaagtaaatatgttacttaaattttctttcctgtaaaatggttaaaatattaaatatttgttttgaagaga

SEQ ID NO: 191886 - DNA, 592 bp, Homo sapiens
  Payload ID: 17914
  Gene Name: trafficking protein particle complex 13
  ENST ID: ENST00000504751
  CDS Start-End: 17-262
aaaagtgccggtcaaaatggaagtgaatccccctaaacaggagcacctgctggcgctaaaagtgatgcggctgactaagcctactttattcaccaatatcccagtaacatgtgaagagaaagacttacctggagatctctttaaccagctgatgagagatgatccttcaaccgttaatggtgcagaagttttaatgttgggagaaatgctgactttaccacagaattttgggctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagactgatgaagtatttctggaagcccagattcagaatatgacaacctcacctatgtttatggagaaggtttcactggagccatctattatgtacaatgtaacagaattaaattcag

SEQ ID NO: 191887 - DNA, 643 bp, Homo sapiens
  Payload ID: 17914
  Gene Name: trafficking protein particle complex 13
  ENST ID: ENST00000504243
  CDS Start-End: 1-161
cagtaacatgtgaagagaaagacttacctggagatctctttaaccagctgatgagagatgatccttcaaccgttaatggtgcagaagttttaatgttgggagaaatgctgactttaccacagaattttgggctgatcttcagacaagttctcagcgtttaaatctttcagcctccaatgctgcagtggctgaacttaaaccggattgttgtattgatgatgtcatacatcatgaagtcaaagaaattggaacacacatcttggtatgtgctgtgagttatacaactcaggctggagaaaaaatgtatttcagaaaattcttcaaatttcaggttctcaaaccattggatgtgaaaaccaaattttacaatgcagagagtgacctcagttctgtgactgatgaagtatttctggaagcccagattcagaatatgacaacctcacctatgtttatggagaaggtttcactggagccatctattatgtacaatgtaacagaattaaattcagtcagccaagctggagaatgtgtgtctacgtttgggtcaagagcatatttgcaaccaatggatacacgccagtacttatactgcctaaagccaaagaatgaatttgcagaaaaagcaggcatcattaagggagta

SEQ ID NO: 191888 - DNA, 2716 bp, Homo sapiens
  Payload ID: 17915
  Gene Name: trafficking protein particle complex 2
  Uniprot ID: P0DI81
  ENST ID: ENST00000359680
  CDS Start-End: 131-553
acatcccagggtatcgcgagaactgcttcggcgttctggctacaggttcggggcgcgggtctcttccgcggaaactgacattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaag

SEQ ID NO: 191889 - DNA, 2776 bp, Homo sapiens
  Payload ID: 17915
  Gene Name: trafficking protein particle complex 2
  Uniprot ID: P0DI81
  ENST ID: ENST00000380579
  CDS Start-End: 194-616
attgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctc

SEQ ID NO: 191890 - DNA, 678 bp, Homo sapiens
  Payload ID: 17915
  Gene Name: trafficking protein particle complex 2
  Uniprot ID: P0DI81
  ENST ID: ENST00000458511
  CDS Start-End: 105-629
ctcttccgcggaaactgacattgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactca

SEQ ID NO: 191891 - DNA, 562 bp, Homo sapiens
  Payload ID: 17915
  Gene Name: trafficking protein particle complex 2
  ENST ID: ENST00000518847
  CDS Start-End: 341-562
atcccagggtatcgcgagaactgcttcggcgttctggctacaggttcggggcgcgggtctcttccgcggaaactgacattgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggtaagtgacatgaggtagagttggttttagcttcccccgacggatgcctcctggaaatttctaaggcaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggca

SEQ ID NO: 191892 - DNA, 561 bp, Homo sapiens
  Payload ID: 17915
  Gene Name: trafficking protein particle complex 2
  ENST ID: ENST00000519885
  CDS Start-End: 71-412
ctcttccgcggaaactgacattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaaggtatggtatgttctataatttttaaattctgatgagaaaggattcgacctttgtcaggaaactggcctattgaagtaactcccttaggctgcagtttacctttcagactagctttcccccatcagaactatctctggcaactccctccgcaggtaagtcttcacagc

SEQ ID NO: 191893 - DNA, 2215 bp, Homo sapiens
  Payload ID: 17916
  Gene Name: trafficking protein particle complex 2-like
  Uniprot ID: Q9UL33
  ENST ID: ENST00000301021
  CDS Start-End: 66-488
gctttggaggccgcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggtttaagccactga

SEQ ID NO: 191894 - DNA, 1084 bp, Homo sapiens
  Payload ID: 17916
  Gene Name: trafficking protein particle complex 2-like
  ENST ID: ENST00000565205
  CDS Start-End: 21-248
ctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaagttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcag

SEQ ID NO: 191895 - DNA, 3102 bp, Homo sapiens
  Payload ID: 17916
  Gene Name: trafficking protein particle complex 2-like
  ENST ID: ENST00000565504
  CDS Start-End: 25-750
gtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccaggtgggccctactttctgtgtcttgccaccttctttctgtaggacatgccttgccattttggttgccaaaatgcaaccatttggaaaataagggaggaaagatctttttaagctatgagcaccatccccctagggcagaggttttaaagccacaaagccccgtttctccacaccaactcttacacagatctccagcgcataaagtggatagagtgtgtgtggtgtggggagtagagcttgcccatttggcttcccaggtgtgcccagtgggtacctggggcacctgcaggactcagggccaagcacatgggcagtggctttcagggatcacacgtccttttgtagctacctgatcttttatgttgaatttggaacagtcaggaacctggtttgcaggtgtcttccgaatagtccacaaagtaaacagatttaacttttgaacatcatgagggaaatgtggggtccatgcccacattccagacttgctttcagtgagtccccagttccaagacataattccctgtggttggcagggaagaggacgctgcagtgatccaaggcaggcccctccctccaccaggacactgtcttggggccatcctggtcccagatgggagcaggcaggcgaatgtccacagtcttgcctcctgggctgcacagggccatccttgccacaccaccgctctgcctgcccatgctgctccctcctccaccccttcctggggccttgggaggctgcacagggaacttggaggcagcagatgggttctcagtgcccggtggggtgggactcctgtcctggcctctcagcggagttcacatttctggaccctggagaaggtcccgagcatcctgtggatggagccatgctgcccggcccgtctctgagcagaggggtggagggcctggctctcctctgagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacaggggagggccctcctctttctggacttggcctccattctttgcatctggctcaatgtctggattccgcccggccttaaaaggagcccttgtgaaacctgggaagcctcgtggccccgcggcgttggctcagctgcagccctggtcctaaaccttggagcgcagacttgaggcaccccctcctgcctgttggtgctgagggggttgggtgctgtgtcacttgatgacgtggctgactaccacccagggcagcggccgagcccatagtggcgtcagtgccgccggcgtccttggggtccagcggtcaaggctcagcccgctgaggggacccccccggagttggttccagcactggtccaggactggagagtttctcaaggaccttgaggaccccagaagcccttgcagcaggaaaggctgtaagggggggtcagcctagggcaggacctagggaggggaactttcttgatacatatttgccttttcatcccatctagcaagcacagtgttaattttagaaattatagaagaaaaaatcagcaaggagtgtgggaaaactgcatgccccaggcctcccccgccccagggtgaattggaagccctggaatgggccgaggcacaccaggcagctgatctgggtgcatgtgggccacagaccactctcacaaggttaaatctttaacaagagcctcatgtttgttaggagaaggtgggaccccagcccaagcacttccccattgcagcctggcatgaaatctttgccttttagtggggatcactcctgcccgagtcctggctgtggtggggactctgcaagttgctaacccagcgtccattctctttcctccgtactaacagaaccccggtgcctctgcccagttccaatagcgggcagacgagagccatgtcctgggctcccttgcagcccggggtgtgcagctgtggcgtggaggtgggtggtgctgggagagacttgcagggaagctcctgtgaaggggactcagctgccacatgcaggacccttcccctttgccttcttcctgcctggaacatggatgtgatggctggtgctgggacagctgtcctgagagcgtgaggaaagggtcacaccctaaggacagtggagcagaacacaggaaggaccctgggcctttgctgacgcagaacgcgggaaggaccctgggcctttgctgacataccagccccagactacttaaattcagctttttttttaatgtgagaaaataaatgcacccctctctggttt

SEQ ID NO: 191896 - DNA, 499 bp, Homo sapiens
  Payload ID: 17916
  Gene Name: trafficking protein particle complex 2-like
  ENST ID: ENST00000567312
  CDS Start-End: 17-346
cgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaagatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagagga

SEQ ID NO: 191897 - DNA, 542 bp, Homo sapiens
  Payload ID: 17916
  Gene Name: trafficking protein particle complex 2-like
  ENST ID: ENST00000562792
  CDS Start-End: 25-138
gtgcctggcgccgagcctcccaagatggcggtgtgcatcgcggtgattgccaaggaggtgcgtacgcgcggcgtggggcgtccgggctcgcaccatcctcggctctccgctttctttctacttcttccctgggcttagaaggcaccttaggaaatgggacctggaggaggccttcgccgagctccagcggtcaggggcttcgcggtggacgagccgccaggcagaccctgactgagaccccagttccgcgctcgcccgtcccgctgctgaacgcacccctcggcgcagcaggtctcctccccgccaggacccaccagaaacctagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagccctt

SEQ ID NO: 191898 - DNA, 915 bp, Homo sapiens
  Payload ID: 17916
  Gene Name: trafficking protein particle complex 2-like
  ENST ID: ENST00000564404
  CDS Start-End: 8-235
tcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaagttaactttccgggccaggcattgattcatgaagagggtgaggtgttccagacagacagactcggagtctaggtggttcggctcctggagtgtgaactgggtaaggcttggctgcctgctcttcgcttctcctgcaaacaccagacgtcgccctagcaaagtatttaggcttgtacccagcacggccactgcaggaccagcccagcatgggcatttcctgtgattcaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagag

SEQ ID NO: 191899 - DNA, 1060 bp, Homo sapiens
  Payload ID: 17916
  Gene Name: trafficking protein particle complex 2-like
  ENST ID: ENST00000564365
  CDS Start-End: 425-604
tctccagaggacagagacagccgtcagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaagttaactttccgggccaggcattgattcatgaagagggtgaggtgttccagacagacagactcggagtctaggtggttcggctcctggagtgtgaactgggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctcctgagcccagaaccagcctaggatctaggggcacaaggggagccggcgtggcttcccacagggg

SEQ ID NO: 191900 - DNA, 558 bp, Homo sapiens
  Payload ID: 17916
  Gene Name: trafficking protein particle complex 2-like
  ENST ID: ENST00000561840
  CDS Start-End: 79-468
ggtgattgccaaggagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggttgccacatttctccaaagtgagggcccacagagggccctccaccggcagtccctgtgttacgagtgccttccctaaccagctgtgcagatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatggga

SEQ ID NO: 191901 - DNA, 854 bp, Homo sapiens
  Payload ID: 17916
  Gene Name: trafficking protein particle complex 2-like
  ENST ID: ENST00000567895
  CDS Start-End: 133-462
gctttggaggccgcgtgaccagcggcgggtcacgtgacgcggtgcctggcgccgagcctcccaagatggcggtgtgcatcgcggtgattgccaaggagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcacccactggctgaacaggtgggctggtctggagggggtggcctc

SEQ ID NO: 191902 - DNA, 801 bp, Homo sapiens
  Payload ID: 17916
  Gene Name: trafficking protein particle complex 2-like
  ENST ID: ENST00000568583
  CDS Start-End: 11-451
gcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaaggtatacggctacgtcaccaactccaaggtgaagtttgtcatggtggtagattcctccaacacagcccttcgagacaacgaaattcgcagcatgttccggaagctacacaactcctacacagacgtgatgtgcaaccccttctacaacccgggggaccgcatccagtccagtgggtctgtttctcttagcagggcctttgataacatggtgacgtcgatgatgatacaggtgtgctgagtgagctgtgctgccagccatcgcagaggagcccgcgcacgactgtggtggggccgtcggtctgttctggttgcctcttcctgaatgggacgcctggggctttcagggcaggcagctgtgcatgttctctcaactaaaggtcttgtgagaggagatttggctttttccttccgtgtcagccaaggatttaattaagaagaattcaactaaggacttttctggggtgtgggcagaggtttgggatcagatggcgcaggtagcctgtcctcagttgtcccaaaggggcagaggcaggggtgcctggagccaagagttcctgagcctgcaggacctgtgaccatgtgggtcac

SEQ ID NO: 191903 - DNA, 281 bp, Homo sapiens
  Payload ID: 17916
  Gene Name: trafficking protein particle complex 2-like
  ENST ID: ENST00000625770
  CDS Start-End: 54-281
gcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactacaagttaactttccgggccaggcattga

SEQ ID NO: 191904 - DNA, 590 bp, Homo sapiens
  Payload ID: 17917
  Gene Name: trafficking protein particle complex 3
  ENST ID: ENST00000373159
  CDS Start-End: 119-475
gcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggaaagaaaaatgtttctgggaaaacaaaacaaaacaaagcgacaggcaaaactgtatgatgccgtgaaggagaggggtgcagcatcatgtacagatgcttctcctttgttgtcctgagtatctgaagtgtcatcttgcagaggccacaggtggcgttcaagatgtacttgggcatcactccaagcattactaattggagcccagctggtgatgaattctccctcattttgga

SEQ ID NO: 191905 - DNA, 1056 bp, Homo sapiens
  Payload ID: 17917
  Gene Name: trafficking protein particle complex 3
  Uniprot ID: O43617
  ENST ID: ENST00000373162
  CDS Start-End: 503-907
cgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagag

SEQ ID NO: 191906 - DNA, 951 bp, Homo sapiens
  Payload ID: 17917
  Gene Name: trafficking protein particle complex 3
  Uniprot ID: O43617
  ENST ID: ENST00000373163
  CDS Start-End: 289-693
cttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgagagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactaga

SEQ ID NO: 191907 - DNA, 1265 bp, Homo sapiens
  Payload ID: 17917
  Gene Name: trafficking protein particle complex 3
  Uniprot ID: O43617
  ENST ID: ENST00000373166
  CDS Start-End: 92-634
tgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaa

SEQ ID NO: 191908 - DNA, 1336 bp, Homo sapiens
  Payload ID: 17917
  Gene Name: trafficking protein particle complex 3
  ENST ID: ENST00000616395
  CDS Start-End: 137-703
gcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatgagctctgagctcttcaccctgacctatggtgccctggtcacccagctatgtaaggactatgaaaatgatgaagatgtgaataaacagctggacaaaattctcttctctaacttccttcccaggggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaatc

SEQ ID NO: 191909 - DNA, 1305 bp, Homo sapiens
  Payload ID: 17917
  Gene Name: trafficking protein particle complex 3
  Uniprot ID: O43617
  ENST ID: ENST00000617904
  CDS Start-End: 268-672
cgccgtccgcgccgttcgcgccgcccccgccccggagccccgcgcccgcagcctcccggcgcctctcccacggccacggccgagcgggctccacggctccaggagttcgccgcgctagctgcctccccctgcgtccgcgtcttggtacgcgccgcagcgcctgaggactaaagctctgagctcttcaccctgacctatggtgccctggtcacccagctatgtaaggactatgaaaatgatgaagatgtgaataaacagctggacaaaatgggctttaacattggagtccggctgattgaagatttcttggctcggtcaaatgttgggaggtgccatgactttcgggaaactgcggatgtcattgccaaggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaatc

SEQ ID NO: 191910 - DNA, 1114 bp, Homo sapiens
  Payload ID: 17917
  Gene Name: trafficking protein particle complex 3
  ENST ID: ENST00000616074
  CDS Start-End: 137-481
gcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtggcgttcaagatgtacttgggcatcactccaagcattactaattggagcccagctggtgatgaattctccctcattttggaaaataaccccttggtggactttgtggaacttcctgataaccactcatcccttatttattccaatctcttgtgtggggtgttgcggggagctttggagatggtccagatggctgtggaggccaagtttgtccaggacaccctgaaaggagacggtgtgacagaaatccggatgagattcatcaggcggattgaggacaatcttccagctggagaggaataaccatccctacaactcgaggatagccatcaggagcactgttggaatcagcaggcctctgtgctccctctgccctccagaactcagtgactcttgaacatggatgttatatattcttataacctgtttccattctccattcaaataaagagcagactgcgatatagtccatttaccccatgtgtgcacattcaggagcgacagtctctgcccccattcccttgagaggggctggatgtaatcacctttggttggactagaaagagctcaaaccattttacattcctgtttgaatttttccaaagcaaaactcactttgaccccattaagaggcaagcctggcacatctatccctgggcctttagaaagccatttgcctcaaatggctatagggttgtggggtggagggaggaagggctgggagggagtggggaggaattgctagctgtagtgtgacacattgtagtgtttgccaggaaaggagccagtcatgccggaaacactgacttctgggaagccacccaggtctcattcctccctgctgttggaggcaacatctcctctttttacagagggtacatccttttttcttacaaattcttcaataaagacacattcttgagtgaaatcccaatc

SEQ ID NO: 191911 - DNA, 2421 bp, Homo sapiens
  Payload ID: 17918
  Gene Name: trafficking protein particle complex 3-like
  Uniprot ID: Q5T215
  ENST ID: ENST00000356128
  CDS Start-End: 163-456
agtttcaaaatattctgacaggacacagacagccctggctgaaaggagcacagagagaatacttcgagctcatgctgagagaaaaaggcgagtttgtcttttcttacctgagactgggcctgaagggagagtttcagttcttcattgacggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaatatgatttgatttttctcatgtattagcttggcttatagctttagccttctgacgctacccttgatttgtaatcaccaagtcaagctatttattcaatgataattttgaaacatttataaataacatttaattttaatttatttagttttaatatagctggcatcaaccaaattccttccttttctcatgaaatattgcttgatggtcaggccaggaaacttctaaaataaaggataaataatattctttgaaattactttcttaccccaaagcttattaattcagaatttctactatcattttcatcctctaaaaaatcttccaaaggatgttttctttgtgaccagaacacatttaaaattcaagtgtaccgaattaaatacacagtaatcttcaccagaccactggcacacaagggcggcctacaaggcagcccagaatctactgggctctgcagagagcccaaattgcaagtacaagttataattagtgtgataccaccctacggaattggagaaaatatttgtaaactatgtatctgacacccttgtgctattaataaccagaatatataaggagttcaaccaactccataggaaaaaattaaaattaataatccaattaaagatgggcaaaagatctgaatagacatttctcaaaagaagacatacacatacaaatggcaaacaggtatatgaaaaggtgctcaacatcattggtcatcagagaaatgcaaatcaaaactataatgagatattatctcaccctagttaaaaatggcttttatccaaaacaggcaatagtgaatgcttgcaaagatgtggagaagagggaactctggtacactgttggtgggaatgtaaattagtataaccactatggagaacggtttggaggttcctcaaaaaacaaaaaatagaatgatcatatgatccagcaatcccactgctggatatatacccaaaataaaggaaatcagtatatcaaagagatatctgcactcccatgtttactgcagaactactgacgatagctaagatttggaagaaatctaagtgtccttcaatagattaatgaaataaagaaaatatggtacatatacacaatggagtactattcagccataaagaagaatgagatcctgtcatttgcaaaacatggatggaactagaggtcattatgttcaatgaaatatgtcaggacagaaagacagactttgcatgttctcatttatttgtaggagctaaaaattaaaacagtggactcatggagatatggagtaaaatgatggatatcagaggctgggaagggtagtttcaagaggagtggagatggttaatgggtacaaaaatatagttagatagaatgaataagatctgggtcgggcatggtggcacaagcctgtaatctctgcactttgggatgccaaagtgggaggattgcttgagctcaggagtttgagaccagcttgggtaacatagacccctgtctct

SEQ ID NO: 191912 - DNA, 1113 bp, Homo sapiens
  Payload ID: 17918
  Gene Name: trafficking protein particle complex 3-like
  Uniprot ID: Q5T215
  ENST ID: ENST00000368602
  CDS Start-End: 97-642
tacaaaaacaaaacaaaaagacatggactgatacacctctaagaaacaggcaaaagaagagaaattgaagatcatattcttcatctatcaagcactatgtctcgccctgcacaccgaagaccagaataccataaaataaataaagatctctttgtccttacctatggagctctggttgcccagctgtgtaaggattatgagaaggatgaagatgtgaaccaatatttagataaaatgggttacggcattggaacgcggcttgtggaagactttttggctcgatcctgcgtgggaagatgccatagttattcagaaattatagacataattgcccaggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaa

SEQ ID NO: 191913 - DNA, 975 bp, Homo sapiens
  Payload ID: 17918
  Gene Name: trafficking protein particle complex 3-like
  ENST ID: ENST00000437098
  CDS Start-End: 1-504
aataaagatctctttgtccttacctatggagctctggttgcccagctgtgtaaggattatgagaaggatgaagatgtgaaccaatatttagataaaatgggttacggcattggaacgcggcttgtggaagactttttggctcgatcctgcgtgggaagatgccatagttattcagaaattatagacataattgcccaggttgctttcaagatgtacctgggaattacaccaagtgtgacctgtaacaattcaagcaaaaatgaattttccctgattctagagaagaatcccctggtggagtttgtggaagagctccctgctgggcgatcttctctgtgctactgcaacttgctctgtgggattatcagaggtgccttggaaatggttcatttggcggctgatgttacattcttgcaagacagactaaaaggtgacagtgtgacagaaataggaataacatttctaaaaaagcgagacgagaaaaaatatagagggaaaaaatgaagactagcacggaaaatgccacggggcggctagctgagttaatgttagctaaacatgtatagacatagaaattttgaattgcttcatagcatgagctttgaaaggtttataaatcagccagaaatttgaaatgcagggcatgaaggcttaaaggtttttttttccttttgcttataaatcacgcattttcaatctcatgtccacaaaatttcatatgcaaatagctccttacaagatagcaggcaggaattccacatcttacactatccatcctcagagaagctgttcattccattcacgtatggtaatgggaaaaaaaagcagcacaaatacaaacagttgtgtatttgtctctttgctgaaaaaaaaagaatgaaatgatatagcatagagtttcctatatatagacagtagtttctagatactgtatattgcattccttaaataaataattccatatttctaaaaaaa

SEQ ID NO: 191914 - DNA, 849 bp, Homo sapiens
  Payload ID: 17919
  Gene Name: trafficking protein particle complex 4
  ENST ID: ENST00000359005
  CDS Start-End: 31-576
gaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgccatcggctcccagctgtctcctgaacagggaagctcaggcattgagatgctggagacagacacattcaaattgcactgctaccagacactgacagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttggtgtttgc

SEQ ID NO: 191915 - DNA, 794 bp, Homo sapiens
  Payload ID: 17919
  Gene Name: trafficking protein particle complex 4
  Uniprot ID: Q9Y296
  ENST ID: ENST00000434101
  CDS Start-End: 31-528
gaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttgg

SEQ ID NO: 191916 - DNA, 1209 bp, Homo sapiens
  Payload ID: 17919
  Gene Name: trafficking protein particle complex 4
  ENST ID: ENST00000533058
  CDS Start-End: 31-804
gaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgccatcggctcccagctgtctcctgaacagggaagctcaggcattgagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcagagcgtgcagggggaaggccaccgtgggatggtgctccggaacctggactctcttcactcagccttcttggacactcggcccatcttggtgcggatgtttcgtaggaggaagaaggcagccgtgctggccgcacaaatcacttcagccacccagaaggctgtgctccaactgtagtgcttggcaatggtgctgaagggcagcccagccagaaagccgcccactgtcagggggaaagggaagaacctaagccagtggtgctagctccagcttctcactggtctatatgcaaagcacaggtgggggtgagggagagactctagaagttaacacttaccattggccatgagtcccacaatggcgtgggaggtgccacacaagttgggaggggcactctcgttggctatgactccaaacagggcaatggggccatacgaggagaaaccaaatacagctcccaataccaggatccagagctgccaagggcagagtggagtggcattcagagtcggaaagccgacctgcctacccacccctgccaaagcaagaagaaggcttggtccccagaaacaaacagtagtcataaaaggacagtaagtaa

SEQ ID NO: 191917 - DNA, 768 bp, Homo sapiens
  Payload ID: 17919
  Gene Name: trafficking protein particle complex 4
  ENST ID: ENST00000525079
  CDS Start-End: 7-360
gcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgtaagtcccccgtctcctgaacggcagcgcttgtaatttgtctaccttttcttaaatcgtcgttctggtgttatgaaaaacgcaaccgatccagatctagattttaggctctttgccatcggctcccagctgtctcctgaacagggaagctcaggcattgagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggt

SEQ ID NO: 191918 - DNA, 654 bp, Homo sapiens
  Payload ID: 17919
  Gene Name: trafficking protein particle complex 4
  ENST ID: ENST00000525303
  CDS Start-End: 31-411
gaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgt

SEQ ID NO: 191919 - DNA, 1759 bp, Homo sapiens
  Payload ID: 17919
  Gene Name: trafficking protein particle complex 4
  Uniprot ID: Q9Y296
  ENST ID: ENST00000533632
  CDS Start-End: 365-1024
cggcgaagcgctcgccctctagcctgaggcggaagacaggaagtggattctagttcccaagccgcaccgcctaaatactgccggagtctgcgctagttgtgacgcatactatagcgctgttttcctgcactgataaacgaaaagcaatccaccaggtctcggcagctaactttccggcactacttatgcccgagcgtgtcgctcccagtgcgcaagtgcagcaggtggctgcacggggggcgcgggaggaggaggaggaggaggaggaggctggggtggggccggcggcaagtgctgtgatgcggttccggggaggggccgtcgggtagaggctgaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcgctctttgccatcggctcccagctgtctcctgaacagggaagctcaggcattgagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttgatcttggtgtttgcaatctgtcttaatcgatggttttgggggaaagatacaggaagtgagtcaaaaatggttagggaattctgggaagatgattatgtgctagtaaaaaacataacaaatatgtgttcattaaataaatgaacataagattttgaagcatgagcattggatctagtcccagaattgctgctgatttcctggggtcctggggtggtggcagcagtggtggtggctgttatgatgatgatgatgatggaacatatttcaagcacttacagccaggcattcctgctttatctcacttgatcttcaccctaactccagggggtacattctgttacagataagagatttagcagactttctgcctcaaagtttccaagctagttactgacagtctgggtttgaaccaggctttctggctacacactcagtaaaccactgttacacttcttccctccatcaagttatttaat

SEQ ID NO: 191920 - DNA, 817 bp, Homo sapiens
  Payload ID: 17919
  Gene Name: trafficking protein particle complex 4
  ENST ID: ENST00000533012
  CDS Start-End: 2-382
gatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggtacacggccgacgggaaagaggtgctggagtatctgggtaaccctgctaattacccggtgtccattcgatttggccggccccgcctcacttctaatgagaagcttatgctggcctccatgttccactcggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggacccccaaattctgagagttcctgcaacaagaatactgctgttgacactccagtggaaatcccagcagccttgttagtgcacttgaaagtgggagaatgctgaccctgatgacttgtactgattcctgagccttaacactgtgctctttccttctgtatataccatggtcttactttccaactctgtacagatttatttatggaggagctaggtccataaatgttgtaataaatattcctttga

SEQ ID NO: 191921 - DNA, 583 bp, Homo sapiens
  Payload ID: 17919
  Gene Name: trafficking protein particle complex 4
  ENST ID: ENST00000528230
  CDS Start-End: 31-561
gaataccagtttccgagcggcaaggcagcgatggcgatttttagtgtgtatgtggtgaacaaagctggcggcttgatttaccagttggacagctacgcgccacgggctgaggctgagaaaactttcagttatccgctggatctgctgctcaagctacacgatgagcgtgtgttggttgctttcggccagcgggacggcatccgagtgggtcatgcagtgctggccatcaatggcatggacgtgaatggcaggctctttgccatcggctcccagctgtctcctgaacagggaagctcaggcattgagatgctggagacagacacattcaaattgcactgctaccagacactgacagggatcaagtttgtggttctagcagatcctaggcaagctggaatagattctcttctccgaaagatttatgagatttactcagactttgccctcaagaatccattctattccttagaaatgcctatcaggtgtgagctctttgaccagaacctgaagctagctctggaggtggcagagaaggctggaacttttggacctgggtcataggctgaacctgttatggaccccc

SEQ ID NO: 191922 - DNA, 849 bp, Homo sapiens; identical to SEQ ID NO: 191914
  Payload ID: 17919
  Gene Name: trafficking protein particle complex 4
  ENST ID: ENST00000625526
  CDS Start-End: 31-576

SEQ ID NO: 191923 - DNA, 1209 bp, Homo sapiens; identical to SEQ ID NO: 191916
  Payload ID: 17919
  Gene Name: trafficking protein particle complex 4
  ENST ID: ENST00000625680
  CDS Start-End: 31-804

SEQ ID NO: 191924 - DNA, 654 bp, Homo sapiens; identical to SEQ ID NO: 191918
  Payload ID: 17919
  Gene Name: trafficking protein particle complex 4
  ENST ID: ENST00000630169
  CDS Start-End: 31-411

SEQ ID NO: 191925 - DNA, 768 bp, Homo sapiens; identical to SEQ ID NO: 191917
  Payload ID: 17919
  Gene Name: trafficking protein particle complex 4
  ENST ID: ENST00000626820
  CDS Start-End: 7-360

SEQ ID NO: 191926 - DNA, 794 bp, Homo sapiens; identical to SEQ ID NO: 191915
  Payload ID: 17919
  Gene Name: trafficking protein particle complex 4
  Uniprot ID: Q9Y296
  ENST ID: ENST00000629713
  CDS Start-End: 31-528

SEQ ID NO: 191927 - DNA, 583 bp, Homo sapiens; identical to SEQ ID NO: 191921
  Payload ID: 17919
  Gene Name: trafficking protein particle complex 4
  ENST ID: ENST00000627703
  CDS Start-End: 31-561

SEQ ID NO: 191928 - DNA, 1759 bp, Homo sapiens; identical to SEQ ID NO: 191919
  Payload ID: 17919
  Gene Name: trafficking protein particle complex 4
  Uniprot ID: Q9Y296
  ENST ID: ENST00000629243
  CDS Start-End: 365-1024

SEQ ID NO: 191929 - DNA, 817 bp, Homo sapiens; identical to SEQ ID NO: 191920
  Payload ID: 17919
  Gene Name: trafficking protein particle complex 4
  ENST ID: ENST00000630040
  CDS Start-End: 2-382

SEQ ID NO: 191930 - DNA, 790 bp, Homo sapiens
  Payload ID: 17920
  Gene Name: trafficking protein particle complex 5
  Uniprot ID: Q8IUR0
  ENST ID: ENST00000317378
  CDS Start-End: 188-754
cctggtgagaccctacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggagggtgggtttctccccagtgtagagggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctccc

SEQ ID NO: 191931 - DNA, 765 bp, Homo sapiens
  Payload ID: 17920
  Gene Name: trafficking protein particle complex 5
  Uniprot ID: Q8IUR0
  ENST ID: ENST00000426877
  CDS Start-End: 161-727
gtgagaccctacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggaggggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctcccca

SEQ ID NO: 191932 - DNA, 5498 bp, Homo sapiens
  Payload ID: 17920
  Gene Name: trafficking protein particle complex 5
  Uniprot ID: Q8IUR0
  ENST ID: ENST00000596148
  CDS Start-End: 49-615
aaagcagctcggccgagcagactgctgcggttcctgggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctccccacgtgtgtcttgtgtcttgtgtggcggccttagatccactcagtaccttgagccacagccctgccccaggctggggagggaggccaggtccgaatgtgtttacagtagagtgggggcgggtctggccatagggttggggggttgagtgagaccaggagtggtggggagaaataaacccggcaaaaggagttggtgggaaatgctggcaggttctggaatcacggttggaggctgtctgcaggctggagggggcatggggtcctgggagacgcatcaggctgagacagacgcctttagactgggggtgggcaaactgcgcaaagtgccagatgggcaatattttatgccatgtggtctttattattattttttttatttgttgagatagagtcttgctctgtcgcccaggctggagtgcagtggcaccatctcacctcactgcaaacctccaccttgggttcacgtgattctcctgcctcagcttcccaagtagctgggattacaggtgcctcccaccacacccggctaatttttgtatttttagtagagatggggtttcaccatgttggtcaggctggtctcgaactcctcatctcaggtgatccgcccacttcagcctcccaaagtgctgggattacaggcgtgagccactgctgtgccgccatgtgctcttgccccattactccgctgatgtactgaatgcaaccacagacaacatgtaaaggagtgggtgtcaccgtgtgcctagaaaacaggcagagggagattgtttgccttcttccctcatttattatatttttcagagacagggttttgttctgtcgcccaggctggagtgcagtggcagcatctcggcttcggctcactgcaagctccgcctcccgggttcatgtcattctcctgccccagcctcccgagtagctggaactacaggtgcccaccaccacacctggctaatttttcgtatttttagtagagacggggtttcaccatgttagccaggatggtctcgatctcctcacctcgtgatctgcccacctcggcttcccaaagtgctgggattacaggcgtgagccatggcgcccagccatgcccagctaatttttaaaaaatttttgtagagatgggggctcttattaggttgcccaggctggtctcaaactcttggcctcaagcaatccttccaccttggcctccgtaagtgctggggttacaggcgtgagccaaatcaaagtgtgttctgtagatcagcagtagcagcatcaactgggagttggtccataatgcagtctcaggcccaccccagagctgctgaatctgagggtgcattttagcgaggcccccaggggattcctggggaccttagattgagatgcaggctttagggtatcagaatcaccaggaggggccacgtgcggtggctcacgcctgtaatcccagcactttgggaggctgaggcaggtggatcacctgaagtcaggagttcgagaccagcctggctaacatggcaaaaccccgtctctactaaaaatagaaaacattagccgggtgtggtggcacatgcctgtaatcccagctacttgggaggctgaggcaggagaatcgctccaacccgggaggtggaggttgcagtgagccgagattgcaccattgcactccagcctgggcaacaagagcgaaactccatctaaaaaacaaaaaggtcaggcgcggtggctcacgcctataatcccagcactttgggaggccgaggcaggcggatcacgaggtcaggagttcgagccagcctggccaatatggtgaaaccctgtctctactaaaaatacaaaaattagctgggcatggaggtgcattcctgtagtcccagctacctaattttttgtatttttagtagagatgaggtttcactgtgttggccagtctggtcaatactttaaagttaattttaaagtccaggatgatacaaacacatttcccttgttaaaaaaattttaaaataagtggggtgcagtggtgcacacctggagtcccagctattcaggaggccgaggcagaaggatcgcttgaggccaggggttggtgtccagcctgggcaacatagtgagaccttgtctaaaagaatttgaaataaggccaggcgtggcgacttatgtctgtaatcccagcactttgagaggccgaggtgggcagatcacttgaggccggaagtttgagaccaacctggtcaacatggcaaaacccatctttactaaaaatacaaaaattagctgggcgtggtggcaggcacctgtaatcccagctacttgggaggctaaggcaggaggatcacttaaacctgggaggcggaggttgaagtgagccaagatcacaccactggcactccagcctgagcaacagagtgagaccctgtcttaaaaaagaaaaaaaaagtaatgtattacacctcaggcaattttcctttccctttttgttcaccacacttggttcctgataactcctcctctcccccaaggaaagttcttccagattttttgggggaaccatgatccaatcttccctgcttcctttccaccgccccccagaatgtgaacagacaggtctgttcagaaaaggaactgcagggactgtcagctgggctcccctcactggttatgagaagggccaaaggggtcggtgtcacctctagatttgtttaggatgctctgttggactgcctggtggaccagggctgagggcttggtcagggcagtctcagccatcctagcaagaggcattgagcagggtgggcttcagcacactggggagaaggtggcgtctctaggatgaatgaaaccattgagcaaccaccacacatagccccagggctgatcctggaatagctgttggctgttggaggtggagggaggcgccgggagagggcttgggcaggatgatagcctgaatctggaatgagggggaggcgtctagggggccagcagatgcacaggtcttggggtttggggtctggagttctggagggaggtctgggcgtctgcacagacacagaaaccacagtcctggatgggggacggagggaggggaacatggtgtctgagaagctggatttcagagcaaaatgcaggacgctttgggctaagcagccccaggcaggtcctctgagaccctggcgagaggggcttccagggccggccagggcaggggccattcttctgtccagaggcggggctgtgagggatgtcagagaaatcgggagggaggaagaggggctgcgggaatttgtaagctgggagtgcagggcccagggtctgttcccacgccccatccccaccggccaccgagggtgagttagggggcttgaggagaagggaaaacgtttgaacaagctgtagggttatgaggctgggcccggggttggggcaagggaggatgaagagaaagaagagcctgtggttcggcagcttctgatcacagcagctctaacttacggtgctctgggctgcaaggaaggtcttcccctggaccctccaggtgggtgggtgagaggaagaggaggaggaggagccaggcaccagcccttggtgagctgggcaagcagcatcagctcatttcacaggcaggttccaaaagaagtcatgtgcccatggtcacacagattaattattattattattattatttagagatggagtctcactctgtcgcccaggctggagtgcagtggtgcgatctcagatctcagcctcctgggttcaagcaattctcctgcttcagcctcctgaatagttgggactataggcatccgccaccacacccagctaatttttgtatttttagtggagacggggtttcaccatgttggccaggctggtctggaactcctgacctcaagtgatctgcccgccttggcctcccaaagtgctaggattacaggcgtgagccaccgcacctggctggctttttctcttttcttcttctttttttttgagacaggttctcactgtcgcccaggctgagagcaggggcacaatcctcccacctcggcctcccaagcagctgggaccaagttgcccatcactacacctctagtttttgtattttttgtagagatggggcctcactatgttgcccaggctggcctcaaactcctgaactcaagcagtcctcccacctcagcctcccaaagcgctgggatgacaggcatgagccactgtgcgcagctggctttggccttttatctgagctggaggaaacttctggaaagggggcagtgaagagagagccccgggcggaggtgactgctccagtcgaggcagtggcagaaggggtgagcagtgagtgattgtgagcgccgtttgacagcagagcccactggcatttcttatggtcttggacctggaggtgttgtcaggggaaagggaagaggtgcaatgaccccagtgttggcctgagccactggtagaggagtgtggagaggggaccctgtgctcctggcctccctcccgtggcctccggcatgggtcgaccttggccgagcgtgaggctggtgccacctcagcctcccagaccctgagtagggttaacacctccagacccgaaatggcctccggttgaccgggcccactccccatcagcctgtccagccagccagcacttactgagtgccttctgtgtactaagccctgctctgggtacttccatgagtcaactcacgccctcccggcctcagggtgatccaccgccttcccctacagtattccaaggggccattggacctcagaggcttcatgtcctgcacattctccgtgtcatagagcaggaaaaaataaaaacgggagatcgaattcta

SEQ ID NO: 191933 - DNA, 411 bp, Homo sapiens
  Payload ID: 17920
  Gene Name: trafficking protein particle complex 5
  ENST ID: ENST00000595985
  CDS Start-End: 12-377
gtggcggcggcatggaggcgcgcttcacgcgcgggaagtcggcgctgctggagcgcgcgctggcgcggccgcgcaccgagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 191934 - DNA, 805 bp, Homo sapiens
  Payload ID: 17921
  Gene Name: trafficking protein particle complex 6A
  Uniprot ID: O75865
  ENST ID: ENST00000006275
  CDS Start-End: 20-541
aggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaatctga

SEQ ID NO: 191935 - DNA, 514 bp, Homo sapiens
  Payload ID: 17921
  Gene Name: trafficking protein particle complex 6A
  Uniprot ID: O75865
  ENST ID: ENST00000592647
  CDS Start-End: 10-393
ggagggggcatggcggatactgtgttgtttgagtttcttcacacggagatggtggctgagctgtgggctcacgaccccgaccccggcccgggggtgagcgccgggctccgtggggaggaagcgggggccaccaaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcct

SEQ ID NO: 191936 - DNA, 695 bp, Homo sapiens
  Payload ID: 17921
  Gene Name: trafficking protein particle complex 6A
  Uniprot ID: O75865
  ENST ID: ENST00000588062
  CDS Start-End: 20-361
aggcgtgcgaggagggggcatggcggatactgtgttgtttgagtttcttcacacggagatggtggctgagctgtgggctcacgaccccgaccccggcccgggggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaatctga

SEQ ID NO: 191937 - DNA, 758 bp, Homo sapiens
  Payload ID: 17921
  Gene Name: trafficking protein particle complex 6A
  Uniprot ID: O75865
  ENST ID: ENST00000585934
  CDS Start-End: 20-499
aggcgtgcgaggagggggcatggcggatactgtgttgtttgagtttcttcacacggagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 191938 - DNA, 3242 bp, Homo sapiens
  Payload ID: 17922
  Gene Name: trafficking protein particle complex 6B
  Uniprot ID: Q86SZ2
  ENST ID: ENST00000330149
  CDS Start-End: 228-704
cggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgata

SEQ ID NO: 191939 - DNA, 3229 bp, Homo sapiens
  Payload ID: 17922
  Gene Name: trafficking protein particle complex 6B
  Uniprot ID: Q86SZ2
  ENST ID: ENST00000347691
  CDS Start-End: 299-691
cgcccccgcccagcggccggatcgcatctcagctggttggctttggttagagctcccgtcagactttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgata

SEQ ID NO: 191940 - DNA, 541 bp, Homo sapiens
  Payload ID: 17922
  Gene Name: trafficking protein particle complex 6B
  ENST ID: ENST00000554018
  CDS Start-End: 235-541
tttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagtatttagcatttacgtgtggcttaatcagaggtggcttatcaa

SEQ ID NO: 191941 - DNA, 664 bp, Homo sapiens
  Payload ID: 17922
  Gene Name: trafficking protein particle complex 6B
  ENST ID: ENST00000556765
  CDS Start-End: 336-488
gaatgccggggtagaggggaccggaagttgtttttttcgcccccgcccagcggccggatcgcatctcagctggttggctttggttagagctcccgtcagactttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtgagcaggttggatttgaaaattttcttgcaggtttacaaaagatactgcaaggttcaaggatgagttagatatcatgaagttcatttgtaaagatttttggactacggtattcaagaaacaaatcgacaatctaaggacaaatcatcagtatttagcatttacgtgtggcttaatcag

SEQ ID NO: 191942 - DNA, 1000 bp, Homo sapiens
  Payload ID: 17922
  Gene Name: trafficking protein particle complex 6B
  ENST ID: ENST00000555269
  CDS Start-End: 259-411
ctttggttagagctcccgtcagactttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtgagcaggttggatttgaaaattttcttgcaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatg

SEQ ID NO: 191943 - DNA, 6226 bp, Homo sapiens
  Payload ID: 17923
  Gene Name: trafficking protein particle complex 8
  Uniprot ID: Q9Y2L5
  ENST ID: ENST00000283351
  CDS Start-End: 337-4644
ggcctcaacatggcggttccggccgggcagtgaccaaggttttgccgtccgaaggactaagtggtgactgtcggcgtctccacctatcggggtggaatgcgagcacgcggggacgagcgctgagaagcggcggtgacgggaaggggggggtcagtggattgtgccccagaaaccgaagcggcggcgtctgttccttcttgtttctaggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcattggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtatagcgtattagtatctgttgattagaaagtctggtttcaaaatatttttttattcagagaatgggcatttggacataagaaatttcaattcagccctgctgcagatagagaaatgggagcaaggttgtttcaatgaatatctcttgtcattggagaaggagggaagacagggtgtaggagtgggtggcagggagtacaagagccagggtcagtcaagtctggagcagatggggtccttgtgccattgacagctaccatggtttgttccagtctcaatctcggcactaatcggagcagactgcaccaaagtggggagagatcaaaagaccccgttttcagactgaagattccaaacctgtacttggaacaactcttcttgagagatgggtggctagtctgtgtgcctctctgcaactgctgcttatgcttctggatcttaagtgggtctctggcttttcagctccttccactctgtgtcttagcaggtgtgggacaagttggagaggaaggtcacattctaaggacactcatttccttcttgagagtttagggccatgggcttataaaaagtctgaggaggaaagacaagaatgaggaggcataatcacagtggtatctcatatttaaaccactcagctgaatattaaattgaaccgattgttaaacagacactaataaaaaaattaaactatataaacctacaactgaatatattaaaaataaaggtaataaagcactcaaaattacttcctgaatattactcagga

SEQ ID NO: 191944 - DNA, 5014 bp, Homo sapiens
  Payload ID: 17923
  Gene Name: trafficking protein particle complex 8
  ENST ID: ENST00000580104
  CDS Start-End: 152-2932
gcagctgggagtagtactgccggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcattggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactgagaatacttaacattctttttctgtatttctttaaaccctgagaataatttacatgctcataatacaggatatcagcatatttgtgcaccttattaagccccatcttaagaaaacacaaagtctaagtctgctgttacaacttgtcaatggtatacgaatattaggagatgattctgagaaaggaaaggccttgttggcagtactcctgttaagccattagtctctaaattccagctttactgtgaagttctatagagtgttaaatacaaattttcctgtcttgcttcacacagttccttaaaatcagttttgaactttggtcatagagtcttcatatttcagtatttggtggtccctatgacttatacataactttgtaaaaagaaaaaaaaattttttctgatgctttgaatatagttttgaaaggagttttgacttttttcccctcattcatctcagtatagagtgcgctatttcacaatacgatttttgtcattaaaattaccatattctttattatataacgttaactattgagttgatctgtttaaaatataaatctcaagttaattaaaaataagcttttcaaaaatgtattatatttataacaaatatactgtaaatagaataaagacatgctattcactgtata

SEQ ID NO: 191945 - DNA, 4391 bp, Homo sapiens
  Payload ID: 17923
  Gene Name: trafficking protein particle complex 8
  ENST ID: ENST00000582539
  CDS Start-End: 81-4226
cgtctccacctatcggggtggaatgcgagcacgcggggacgagcgctgagaagcggcggtgacgggaagggggggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcattggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaagaatgtaagtcagctgtcaccagatggtcctttgccacagcttcctttaccgtatattaacagttcagcaacacgggttttttttggccatgacagacgaccagcggatggtgaaaaacaagcagctactcatgtaagtcttgatcaagaatatgattctgaatcctctcagcagtggcgagaacttgaggaacaagttgtttctgtggttaacaaaggagtaattccatccaattttcatcccacacaatactgtttgaacagttactcagataattcaagatttccacttgcagttgtagaagaaccaattacagtggaagtggcttttagaaaccctttgaaagttctacttttgttgactgatttgtcattgctttggaagtttcatcctaaagatttcagtggaaaggataatgaagaagttaaacaactagttacaagtgaacctgaaatgattggagctgaagttatttcagagttcttaattaatggcgaagaatcaaaagtggcaagactaaagctctttccccatcacataggggagctgcatattctgggagttgtttataatcttggcactattcagggctctatgacagtagatggcattggtgctcttcccggatgtcacacaggaaaatattccttgagtatgtcagtccgagggaagcaggatttagaaattcaaggtcctcgacttaacaacacaaaagaagagaaaacatctgttaaatatggccctgatcgacgtttagatcccataatcacagaagaaatgccactgttggaggtgttctttatacattttcctacagggcttctctgtggagaaatccgaaaagcatatgtagaatttgtcaatgtcagcaaatgtccacttactggattgaaggttgtttctaaacgtccagagttctttactttcggtggtaatactgctgttctaacaccactaagtccctcagcttctgagaattgtagtgcttacaagactgttgtgacagatgctacctctgtgtgtacagcactcatatcatcagcttcttctgtagactttggcattggcacaggaagtcaaccagaggtgattcctgttccccttcctgacactgttcttctacccggagcctcagtgcagctgccaatgtggttacgtgggcctgatgaagaaggtgtccatgaaattaactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggcagaggaggcaatatgctagtctttgtggatgtggaaaataccaatactagtgaagcaggcgttaaggaattccacatagtgcaagtatcaagtagtagcaaacactggaagttacagaaatctgtaaatctttctgaaaacaaagataccaaacttgccagtagggagaagggaaagttttgctttaaggcaataagatgtgagaaagaagaagcggccacacagtcctctgaaaaatatacctttgcagatatcatctttggaaatgaacagataataagttcagcaagcccatgtgcagacttcttttatcgaagtttatcttctgaattgaaaaaaccacaagctcacttgcctgtgcatacagaaaaacagtcaacagaggatgctgtgagattgattcaaaaatgcagtgaggtagatttgaatattgtcatattatggaaggcatacgttgtggaagacagtaaacagcttattttggaaggtcaacatcatgttattcttcgcactataggaaaagaagccttttcatatcctcagaaacaggagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagtccagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgttggactga

SEQ ID NO: 191946 - DNA, 623 bp, Homo sapiens
  Payload ID: 17923
  Gene Name: trafficking protein particle complex 8
  ENST ID: ENST00000581057
  CDS Start-End: 1-288
gagccaccagaaatggaactattgaaatttttcaggccagaaaacattacagtttcctcaaggccatcagtagagcagctttctagtctcattaaaacgagtcttcactacccagaatcatttaatcatccatttcatcaaaaaagcctttgtttagtaccagtcactcttttactttccaattgttctaaggctgatgtagatgtcatagttgatcttcggcataaaacaacaagaagcactggaaatccatggatcattcacatggcttggacaaacacagtataaacttcaacttaaaagccaggagattcacagtctgcagctgaaagcatgctttgttcatacaggtgtttataaccttggaactcctagggtatttgccaagttatcggaccaagttacagtgtttgaaacaagtcagcagaattccatgcctgccctgatcatcatcagtaatgtgtgacaacttggaaatttgtactgaaatccacaataatcagtttttgctggatgggttttacagcagtatttgatatacctaacttgttatggaggttgattgatatctgatccctgcaaaatactttgacttgtcattttgttgatgatgcaaagcacgt

SEQ ID NO: 191947 - DNA, 563 bp, Homo sapiens
  Payload ID: 17923
  Gene Name: trafficking protein particle complex 8
  ENST ID: ENST00000578658
  CDS Start-End: 1-563
agagtagtaagaggatgcttagataaagggaggaccttgaattctaggaaagggatttgcgattttatgtctaatggtaaatttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcattggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaaga

SEQ ID NO: 191948 - DNA, 3205 bp, Homo sapiens
  Payload ID: 17923
  Gene Name: trafficking protein particle complex 8
  ENST ID: ENST00000582513
  CDS Start-End: 343-2343
gggttcggcctcaacatggcggttccggccgggcagtgaccaaggttttgccgtccgaaggactaagtggtgactgtcggcgtctccacctatcggggtggaatgcgagcacgcggggacgagcgctgagaagcggcggtgacgggaaggggggggtcagtggattgtgccccagaaaccgaagcggcggcgtctgttccttcttgtttctaggctccagtgcgttcggggccccgcccggccgggccaggccggcgggcggcggcggtagctgctgcagccgcaggataacctcgcagggtgggccggagggcgggcgccgccgctgcctgtgctgcggcgatggcccagtgtgtacaatcagtgcaggagctaatcccggactccttcgtcccctgtgtcgctgcgctgtgcagcgacgaagccgagcggctcactcgtctcaatcacctcagcttcgcggagctgcttaagcccttctcccgcctcacttccgaggttcacatgagagatcctaataatcaacttcacgtaattaaaaatttgaagatagcagtaagcaacattgtcacccagccacctcagcctggagccatccggaagcttttgaatgatgttgtttctggcagtcagcctgcagaaggattagtagctaatgtgattacagcaggagattatgaccttaacatcagtgccactactccatggtttgagtcttacagagaaacctttcttcagtcgatgccagcattggatcatgaatttctgaaccactatttagcatgtatgttggtagcgtcatctagtgaagctgaacctgtggaacagttttcaaagttgtcacaagaacagcatcgaattcagcacaacagtgattattcctaccccaagtggtttataccaaatacacttaaatactatgtacttttacatgatgtaagtgcaggagatgaacagagagctgaatcaatttatgaagaaatgaaacagaaatatggaactcagggttgctatttacttaaaattaattctcgaacatctaatcgagcatcagatgaacagataccagatccttggagtcagtatctccagaaaaatagtattcaaaaccaggaatcatatgaagatggcccttgtactataacttcaaataagaattctgataataacttgctttcattggatggattagataacgaagtcaaagatggcttaccaaataactttagagctcacccacttcagttggagcaatccagtgacccttctaacagtattgatggcccagatcatctaagatctgcttcatcgttacatgaaacaaagaaaggaaatactggaataattcatggtgcatgtttaacacttactgatcatgatagaattcgacagtttatacaagagttcacatttcggggccttttgccacatatagagaaaacaattaggcaattaaacgatcagctaatatcaagaaaaggtttgagtcgatctctattttctgcaactaaaaaatggtttagtggcagtaaagttccagaaaagagcattaatgacctgaaaaatacatctggcttgctgtatccgccggaagcaccagaacttcaaatcaggaaaatggctgacttatgttttttggtgcagcattatgatttggcttacagttgctatcatactgcaaagaaagattttcttaatgatcaagcaatgctttatgcagctggtgccttggaaatggcagcagtgtctgcttttcttcaaccaggagcacctaggccatatcctgctcattacatggatacagcaattcagacatacagagatatctgcaagaatatggtgttggctgaaagatgtgtgttgcttagtgctgaacttttaaaaagccaaagcaaatattcagaggctgcagctctcctaatacggttgaccagtgaggattctgatcttcgaagtgcacttcttttggaacaggcagcacattgctttataaacatgaaaagtcccatggttagaaaatatgcatttcatatgatattggcaggccatcgatttagtaaagcagggcagaaaaagcatgctttacgctgttattgtcaagccatgcaagtttacaaaggaaaaggctggtctcttgcagaggatcacattaatttcactattgggcgccagtcctatactcttagacagctggataatgctgtgtctgcttttaggcatattctaattaatgaaagtaaacaatctgctgctcaacagggggctttcctcagagaatatctttatgtttacaaggtgactgcttattttcattcaggaatagatattaaaactgtattttagtgtgaaagtatttatttattaccatatcttacgatagttttattagaatatatgtagttatcagtcataaaaaagctgtggcaggctaggctttttggctatagatcttggttacattgccccttccacagttcttgaaaagagaattttaatattacaatgaacacttgatttgtggctgttcttagaatcttaaaaaaaaaaaagattccacaggttttctggattctttattcatcatgcttttatagactcacaactgattttacagttggttttaagtgggttctctttaccatcctttggagatggacattctatgttcttttccttgtgaaagatgagggggtatggatctgtggaaagtagacaggctattatggtgcaatggagaaaaattaacaggaagaaggactgtttcactgaggcaagcagataaacatataaagcattgttttatggaaaaaatgggaagttgtaaattttttcccaaggcctatgaatagtgcatattatatctatcgtgcagaaaataactacctttagggtctagactttattaatttgaaattatatgggttagaattttggcagataggatgctataatgagtcataagaagtaaaacgcttactaaaataagttttgcatatttaacatccaggtaattagctgagtaacctcagtaagattcttttgaggcagaataaatatctgaagtgcttctgagttgtaaaattttatgactgatatgagaaataaaactagtaattacatatcttaatattcttgcttaacatatttttaatgccttgtgtattaagaaacgaggaaacaaataaaaataccattttcacaaaaa

SEQ ID NO: 191949 - DNA, 4474 bp, Homo sapiens
  Payload ID: 17924
  Gene Name: trafficking protein particle complex 9
  Uniprot ID: Q96Q05
  ENST ID: ENST00000389328
  CDS Start-End: 16-3756
aaagtcgggagtgccatggtgccagctggggatcaagaccgcgcgccacacagggggaagccggcccaggctggggctcgcacctcacgtgcctcccgggccctgcgatcctggaggcgctcccaggccgcgcgcgccacggtcacccacccacgtggggggcacgaccgtgggagtcacggggggtaccgtgagggtcacagggggtgccgcagggatccacagtgggcttccgcggggcctccacccctgagcttcacagaggaagtgaaatttgagctgcgcgccctgaaggactgggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggggcacaggaagttctcattgatccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggtgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccctc

SEQ ID NO: 191950 - DNA, 4297 bp, Homo sapiens
  Payload ID: 17924
  Gene Name: trafficking protein particle complex 9
  Uniprot ID: Q96Q05
  ENST ID: ENST00000438773
  CDS Start-End: 135-3581
agcgccggctcggccgccagtaggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggggcacaggaagttctcattgatccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggtgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 191951 - DNA, 3693 bp, Homo sapiens
  Payload ID: 17924
  Gene Name: trafficking protein particle complex 9
  ENST ID: ENST00000520857
  CDS Start-End: 1-2977
cgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggtgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 191952 - DNA, 455 bp, Homo sapiens
  Payload ID: 17924
  Gene Name: trafficking protein particle complex 9
  ENST ID: ENST00000634178
  CDS Start-End: 1-275
atggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatggtaagcgctttcctaattttaattagcacgtcagggtcctagatactgtgtagcaacccccatcccttgatgcctgctgtttgctgtttgtaactcacttgtcattcattaactcaagctgcctgagacatctcctgggcactttgttaacagagtgtgttactgtatgtgtctgaaagtaataaaagtactttttatctaaatga

SEQ ID NO: 191953 - DNA, 732 bp, Homo sapiens
  Payload ID: 17925
  Gene Name: Trafficking protein particle complex subunit 2B  [Source:UniProtKB/Swiss-Prot
  Acc:P0DI82]
  Uniprot ID: P0DI82
  ENST ID: ENST00000543226
  CDS Start-End: 213-635
gtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttt

SEQ ID NO: 191954 - DNA, 1743 bp, Homo sapiens
  Payload ID: 17925
  Gene Name: Trafficking protein particle complex subunit 2B  [Source:UniProtKB/Swiss-Prot
  Acc:P0DI82]
  Uniprot ID: P0DI82
  ENST ID: ENST00000596755
  CDS Start-End: 1268-1690
gtgacacaggcacaactgacagtggcagaagctcagctgacaaggactggggacggcggtgtccttgtcttgcctttgtcgcccccgcccctctcttccctggctggacttgcggagtccccgccgaagaacccgaggtgggtgccccgtcccaggcccccccccacctccgcccgacccctccttccagtgctgaagcccatagaaggggccctgcaggtcaggccccttgtctcgaagagaggggcgttcctgtgtggggtccccgtatcagctggtttgatgcagcctcagagctcccttcggggatctcaggttcagagcatggaggtgctgccaagtgggccgcgtcggggagcccggagtgtgggttgtttctgcgggaaagagagggttttgtgaattttctcttggaatggcagcctgagcagccggtataaccatggaaggttgtcaagggaagaccagtgggaggggcaggtccagagttagaacgagcaggatggggaattgacacagagagacccagaagaggccactgcagtggatcccagaggctgcaccagagccgtggtataagagggacaatgtgatgggattctggatagacctggaagatagagccaacaggttttcctgccgtatcagatatgtctgtgagcaaaaatagggagtgaagggtcatttttttttttttgcccgaacatctgaaagaatgaagttggggaagtcagcagcatgagaagtaggtttcatggagaagatcatgggttggagtttggccagtgtgattctcaggcgtctcaagttgaaaatgtcacatgggtagggggacagaaaggtgtggagtctacagaggagaactggtgtagattcttcaaaagaatagagggtggccgggcgtggtggctcacgccggtaatcccagcactttgggaggccaaggcgagcggatcacaaggtcaggcgttcaagaccagcctgaccaacatggtgaaaccccgtctttagtaaaaatacaaaaattagccgggggtggtgacgcgcgcctgtaatcccagctattcgggaggctgaggcaggagaattgcctgaacccaggaggtggagattgcagtgagccaagatcgcgccattgcactccagcctgggcgacagagcgagattccgtgtcaaaaaaaggtgcggagcgcgggtctcttccgcggaaactgacattgcgtttccgttgtcggcctcccgctgcaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaa

SEQ ID NO: 191955 - DNA, 5293 bp, Homo sapiens
  Payload ID: 17926
  Gene Name: trafficking protein, kinesin binding 1
  Uniprot ID: Q9UPV9
  ENST ID: ENST00000327628
  CDS Start-End: 401-3262
gataaattcactcctcccccagttcccagcaagccctgagatgaacagcagactttttgttccactttaatttttaggcaaaaccgaatgcccatcacaaagccccgttctccttgctactccccttcccccaacctagaggtatcacatttttgggtgcgtcattttctgtttggggtggcttaacaagatgagctgatagggttcccaggctgcctggagttacataacccattgtgcttccaggacagctcacaatcttaggatttgccctaacaagcaaactcagaaaactgctgaggaaggcacgggagggtggctgtgcgaggtactgccggggctgagctctcatggaggctctctctgttctctgaagtgcctttggagtttatgtctgcacatggcattggtttttcaattcgggcagcccgtcagggctcagcctctgccaggactctgccacggcaagctcattcggacaaacgcctgtgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatgg

SEQ ID NO: 191956 - DNA, 4620 bp, Homo sapiens
  Payload ID: 17926
  Gene Name: trafficking protein, kinesin binding 1
  Uniprot ID: Q9UPV9
  ENST ID: ENST00000341421
  CDS Start-End: 194-2254
gggtgatgctgggccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgtttttaaatacagagtctgatgcctcctatttgtaacaatgggtgtagctcccctgcccatcttggaggtgcatggcccatcagggatctttaaagtgggagcaggaaaggctgctaaaaaaaaaaaaaaaaaaaaaagtgggcttttgggtccctgaaaacatcagtgcccttcttcctggtctgggtgtctccctgagtctaaggggaagattctcaagtcccctggtgatttccaagtggagctgagcagttttagggaaattgagtgctgggtcattcagaaggtaaatgagatcatctgttacctgtacgctgtattaaaatagaaccaggaaaggctcaggatttcagacatttcatcagccttttcactttcccagcttcaatggaggtatatatgtcattttcttttcagcttacacatgtgttcaaagtggatttttaaaaagtgttttagcaatactccttaaccaaataaaccttcggagaacgtcactaagcttttccagagagaagaccctagatgaagttggaaaagagctctggctgactccacccactgtccccaagcattaaaggtgtggccatgagtttacagaattacccacattccagttgccactgggatgaaaagctttgtgctcagagctctgggaatcatgggatcacatggttactgtttaccccaacagcatgctctgtctagactggacctcccagccccttgtgttgggaaggcaaagcttttgtggagtcaggggggagactgagaaaaaatgaattaaccctgtgttgtcatcctcatgacattcctgaggattcaccaggttagaagtgaggacgtttatctttgtgattcataattttcatttgtgaaggccacaacactccccttgaaatacagggcaggaaagagctgaggttcttggtggtgtctcccattcccctggctaatttcagacagctgtggtcaagggattttacttgggatcaacttttccttttttccttgacattaattttagagaagtcatcaagtcatgtgatttgtttagcacataggtttatttatggtttgattttttttaggcagttatattactagattaagcttgtgagggaatgaaaatgttttttatttgttatctacacactcgaaaaagagaaaccagctgcggtactgtcccatttttgtcatcagcaccagtgtccgtcaggaaggcaggtggtggtgcagaaacatgatgcctggctgattttcgtggctaaaggggtaggccttatgttgattgggatgctcccctacagccttacaggtagaatagaaggtgagttctggaagtgcaaagaagcaccattaagtgcatcttctagaagttgtacagaaggactaaagcttatcaagtcaacaaagaacttaccttggaggatagagagagagaagggaccaattatgaggactgacatcctggccactctccttaaaataaacactgacatttttcttgcttgttctctctgtactcaaacctgtggcaaattcatcctagcaacgttatttgacgaggggcatgaacatttatagttgaaactgtagaaagggtcaggttggaggtgtgtaataaaaaagaattacctaggttgccaaaggtaatttaggaagggtctgatcatttagatgagagttctttggggcttattttctgggtaaggctcatctttaaaaactggcttcagaggggagaggggagaacaatgaattggctctattttctctattgggaattacaggaccattttgattcttagaatgtaaaaagcatatcgctaagtaaatcatcctggaggtcccaagtagctctatgcctgcaatcatggagacacaggcagacagataagcttcatggggaaggcatggggcatcctctgtcttgggatttgtatccatggtggtctggtccctgccttttaatccgtcctctacgcttgggcttttctgttaccaaacagcactatcccaggaactattgtctgcctgggaacactcagtagggagacactttggagacaggaggtgatgaacctttttatgtgcagctggtatgatagaaggaaattgggaaaacttgtatgctaggcacttttgtccagagcctgctgtcccatggagaaaaagttttaagcactgaaaaaatttgattaatgtatttaaatgtattatttgaagcatcattcacttgttgatttttacaatcccatgtcttaaaaaggatgaatccatgttattgtattgtaaataatttagatgattaaaatggattgtttaaaaagtt

SEQ ID NO: 191957 - DNA, 5033 bp, Homo sapiens
  Payload ID: 17926
  Gene Name: trafficking protein, kinesin binding 1
  ENST ID: ENST00000396175
  CDS Start-End: 194-2881
gggtgatgctgggccaggagctttgtgtacacccctccacttcagctgagccagggcatgtctgcggcccaggccagggcgcagtgtgtgccctgggggcccaggcctgcatggctcctctgggtagggggtcgggggcacccccaaggatggtcccttagggtgatgttttggctttggggtgacttcagcaatgtccctgcgagacaagggcggggaagaagaatgttttgaatacgactgccaggatgaagagaggaagccaacccacaggcagcatgacacccaggacctcttggaagaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacactggtattctgatttgtattttgtttttatcttttcatcaaggagacgatctctttatgtaagacttgaaagtgtttagctctttgcaaaattaaatgaaaggcatatacttc

SEQ ID NO: 191958 - DNA, 489 bp, Homo sapiens
  Payload ID: 17926
  Gene Name: trafficking protein, kinesin binding 1
  ENST ID: ENST00000418790
  CDS Start-End: 178-312
attgcccactttactgttttggctccagactgtcgttaagaatgtacagcctaattctggtgtgtttcgggatattcttctgtccagtattctggaagggcggggaggcatggcagcgttttacttgacgttgatggtgctgtgaagtccattctttcctctgcaagactactgactatgcagaaatttatcgaagcggattattatgaactagactggtattatgaagaatgctcggatgcacttcctcagttgagtcttttggccctgagagaccctgatctgtcttcctctaagagcaaaggaaaatagaagaggagatggctcaactgttcaaggttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgaga

SEQ ID NO: 191959 - DNA, 3260 bp, Homo sapiens
  Payload ID: 17926
  Gene Name: trafficking protein, kinesin binding 1
  Uniprot ID: Q9UPV9
  ENST ID: ENST00000449246
  CDS Start-End: 302-1972
attcagggctgctgtccagtgctgctttattggcagtgctgccagggtctccgttagctctctgcaaattgccttcctttctgctcctcctactccctccttcccccatagaatttttcttttcattgcccactttactgttttggctccagactgtcgttaagaatgtacagcctaattctggtgtgtttcgggatattcttctgtccagtattctggaagggcggggaggcatggcagcgttttacttgacgttgatggtgctgtgaagtccattctttcctctgcaagactactgactatgcagaaatttatcgaagcggattattatgaactagactggtattatgaagaatgctcggatgttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggtgatcacgcggggcctcggcccctctctgtcctcctgggggactccctttggtccctgatccacctgcggaaggcggggcacctctgtcacgcctactcctttttcttccgcgacagccacccgcgctgctggtttgagttcctctgagggtggtgctcagcctaggcctccgtccctcccctctggctggcaggtgtgacaatgcacacataggccatgaaactcgccgaggaaagacaagcatgtgcactgtggtcttctagttctttcctttgcctttagaaccttagaaataaaaacttttgtggcggtagaggcactgctaactgattcaaaaattaattaggttttgcctgtgggtgtgaggaatgcagaaaattaatgctttagcttttctgcagttttggtgtcggggagaggttccaagcaaactctattaaatggggatttttttttccccataaccacctgaatgtgatttgtgggcttatgtgttctgatttgaacttcatatagcaaggttgtggcttttggcagatgcagtatgttctgagcgcggctcctagagtctacaatttggagtccaggaaggggtggctgtggagacaagtgagttttgtacctccgtaagccaccctttttcagggtcagttcatgtgttagtatcaggggcatctcagatgattaaactcatgggaaaaacttcctccttccctctctccctcttgccctcctgcctctttttttttttttttttttttaatttaggcacttataaaatgttttccctctacctgctgctactctgccaagagccaccaagtgcttatatttttcattttttactcctttagtttggaaagccatatacgtttgagaaggtgttttaaaactctgtgttacacttacgatgcaaagccaaatcagaacttctgtaaggcagaactttcccaactttaaaaaaattattgtcccctctaaggagccttcttagacgttttttcctaatcaccccccaaagacattttaataccacatatatattgtttatgtactatatgtatatacataaacaatacataagcaatacatctgtggtattaaaattaaaaagaatccaattatgtttacctcaaaagaacctgtttttgcttcttgggagcaatattgcccctgtgagactgcatgctataaggtaaggttgtgcttgttaaagacccaagacatgactgggttccacagtctccaaaggaagagggtgggctagtttgtttttattattattttaaaattgtataattggggtctttcttagagttcagaaaaggtatagcttactcttttttaattgtttatttagttgtaagcttggtgattgttttctgatccacattgtgtgtgttcttcaataaaatctttcatttctgcaatttta

SEQ ID NO: 191960 - DNA, 900 bp, Homo sapiens
  Payload ID: 17926
  Gene Name: trafficking protein, kinesin binding 1
  ENST ID: ENST00000427771
  CDS Start-End: 1-900
gatgccaatgtccagattgctagtatctcagaggaactggccaagaagacggaagatgctgcccgccagcaagaggagatcacacacctgctatcgcaaatagttgatttgcagaaaaaggcaaaagctctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggt

SEQ ID NO: 191961 - DNA, 4672 bp, Homo sapiens
  Payload ID: 17926
  Gene Name: trafficking protein, kinesin binding 1
  ENST ID: ENST00000613405
  CDS Start-End: 302-2314
attcagggctgctgtccagtgctgctttattggcagtgctgccagggtctccgttagctctctgcaaattgccttcctttctgctcctcctactccctccttcccccatagaatttttcttttcattgcccactttactgttttggctccagactgtcgttaagaatgtacagcctaattctggtgtgtttcgggatattcttctgtccagtattctggaagggcggggaggcatggcagcgttttacttgacgttgatggtgctgtgaagtccattctttcctctgcaagactactgactatgcagaaatttatcgaagcggattattatgaactagactggtattatgaagaatgctcggatgttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcaggtgagaggtcccaagcacgtgtgactgtctcaggcagcagaagttacccgagccggcctcaggcttccccagaggagatgcaggagccgccagcggccacggaggaggaggaggaggaggaggaggaggaggggtctggtgagggcaccacgataagtcctgtaaacttggcacctttcccggaggcagagttttgggccattctcacctctgttccaggcaccatccgtagtggttctctgtctgtagcttccgctcgtctgtgtgggtgatgattaaagcattctcattgcacagttctgtttttaaatacagagtctgatgcctcctatttgtaacaatgggtgtagctcccctgcccatcttggaggtgcatggcccatcagggatctttaaagtgggagcaggaaaggctgctaaaaaaaaaaaaaaaaaaaaaagtgggcttttgggtccctgaaaacatcagtgcccttcttcctggtctgggtgtctccctgagtctaaggggaagattctcaagtcccctggtgatttccaagtggagctgagcagttttagggaaattgagtgctgggtcattcagaaggtaaatgagatcatctgttacctgtacgctgtattaaaatagaaccaggaaaggctcaggatttcagacatttcatcagccttttcactttcccagcttcaatggaggtatatatgtcattttcttttcagcttacacatgtgttcaaagtggatttttaaaaagtgttttagcaatactccttaaccaaataaaccttcggagaacgtcactaagcttttccagagagaagaccctagatgaagttggaaaagagctctggctgactccacccactgtccccaagcattaaaggtgtggccatgagtttacagaattacccacattccagttgccactgggatgaaaagctttgtgctcagagctctgggaatcatgggatcacatggttactgtttaccccaacagcatgctctgtctagactggacctcccagccccttgtgttgggaaggcaaagcttttgtggagtcaggggggagactgagaaaaaatgaattaaccctgtgttgtcatcctcatgacattcctgaggattcaccaggttagaagtgaggacgtttatctttgtgattcataattttcatttgtgaaggccacaacactccccttgaaatacagggcaggaaagagctgaggttcttggtggtgtctcccattcccctggctaatttcagacagctgtggtcaagggattttacttgggatcaacttttccttttttccttgacattaattttagagaagtcatcaagtcatgtgatttgtttagcacataggtttatttatggtttgattttttttaggcagttatattactagattaagcttgtgagggaatgaaaatgttttttatttgttatctacacactcgaaaaagagaaaccagctgcggtactgtcccatttttgtcatcagcaccagtgtccgtcaggaaggcaggtggtggtgcagaaacatgatgcctggctgattttcgtggctaaaggggtaggccttatgttgattgggatgctcccctacagccttacaggtagaatagaaggtgagttctggaagtgcaaagaagcaccattaagtgcatcttctagaagttgtacagaaggactaaagcttatcaagtcaacaaagaacttaccttggaggatagagagagagaagggaccaattatgaggactgacatcctggccactctccttaaaataaacactgacatttttcttgcttgttctctctgtactcaaacctgtggcaaattcatcctagcaacgttatttgacgaggggcatgaacatttatagttgaaactgtagaaagggtcaggttggaggtgtgtaataaaaaagaattacctaggttgccaaaggtaatttaggaagggtctgatcatttagatgagagttctttggggcttattttctgggtaaggctcatctttaaaaactggcttcagaggggagaggggagaacaatgaattggctctattttctctattgggaattacaggaccattttgattcttagaatgtaaaaagcatatcgctaagtaaatcatcctggaggtcccaagtagctctatgcctgcaatcatggagacacaggcagacagataagcttcatggggaaggcatggggcatcctctgtcttgggatttgtatccatggtggtctggtccctgccttttaatccgtcctctacgcttgggcttttctgttaccaaacagcactatcccaggaactattgtctgcctgggaacactcagtagggagacactttggagacaggaggtgatgaacctttttatgtgcagctggtatgatagaaggaaattgggaaaacttgtatgctaggcacttttgtccagagcctgctgtcccatggagaaaaagttttaagcactgaaaaaatttgattaatgtatttaaatgtattatttgaagcatcattcacttgttgatttttacaatcccatgtcttaaaaaggatgaatccatgttattgtattgtaaataatttagatgattaaaatggattgttt

SEQ ID NO: 191962 - DNA, 5536 bp, Homo sapiens
  Payload ID: 17926
  Gene Name: trafficking protein, kinesin binding 1
  ENST ID: ENST00000487159
  CDS Start-End: 835-3384
agagtggggccgcgcgcgggagagccggagcgcagccttagcgtccccgagagtctcgaacgccccgacgacccccgcgtctcggaaccccggactccgagcccaggagcgccagagcggcaggcgggcagcaggaggcggcggcgccagagcggagcccccgcgagtgcccccgtgccgcccggccggctgcagcggagggaaccgaagccgccgggcggccggggccgggccgagaacgacgcggaggaagcccccaccgaggccccccggcaccgcgcctgctgccgggttgcgctccgtgcacctcttgcggattccctataaggagcccctgctggtgcaccagaactaccgggggccatctgcccaactgccccagactctggcagtggggcccccgatggcagtgggcacctccccgtgaaacctgccaagctggacgccacagctctgcacgacgacactttggccaactccgtgcccccttcggaggcatgcaaccatgcagtcctagcctgcagcctgggcatccctgaggaacactacataagcgaggctgtggaagatgctcccagctacagagggtaccgggatgcctgcaccattactgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggttccgccacacttcaccactggcagcagttggcccaacctcaccttgggggcatcctggacccccggcccggtgtggtcaccaagggcttccggacgctggatgttgacctggacgaagtgtactgccttaacgactttgaagaagatgacacaggtgaccacatttctctcccacgcctagctacctccactccagttcagcacccagagacctcagcgcaccatcctgggaagtgcatgtctcagaccaactccaccttcaccttcaccacctgtcgcatcctgcatccttcagatgagctcactcgggtcacaccaagccttaactcagccccaactccagcttgtggcagcaccagccacttgaaatccacgccggtggccacaccatgcactccacggagactgagcctggctgagtccttcactaacacccgtgagtccacgaccaccatgagcacatccctggggctcgtgtggctgttgaaggagcggggcatttctgctgccgtgtacgacccccagagctgggacagggccggccggggctccctcctgcactcctacacgcccaagatggctgtgatcccctctactccgccgaactcgcctatgcagacacccacatcctccccaccctcctttgagttcaagtgcacgagccctccctacgacaatttcctggcttccaagccagccagctccatcctgagggaagtgagagaaaagaacgtccgcagcagcgagagccagaccgacgtgtccgtctccaacctcaacctcgtggacaaagtcaggaggtttggggtggccaaagtggtgaactcagggcgagcccatgtccccaccttgactgaggagcagggacccctcctctgtgggcccccggggccagcaccagcccttgttcccagaggcctggtacctgagggcctgcccctcagatgccccactgtcaccagtgccatcggtgggctgcagctcaatagtggcatccggcggaatcgcagcttccccaccatggtgggatctagcatgcagatgaaagctcctgtgactctcacctcgggcatcttgatgggtgctaagctctccaaacaaactagcttacggtgaggactggaggggggccggttgccctagaggagacccacgttctcctctcttgctcccacctccctctcttccccccacagtgcactccctccctctgcccttctctgtccaccccctcctaagctagacaaatcaacctcgtgcctaatggaggaagtgtggaaactttgtaaaatgtgtacataggacttggagaccttgtgtccgccctgctctttcttccgatcccacaggaagtgcccctgcactgtcatcactctcacgaggacgtcacctgtgctaacctgggggaaggtggggtcctttcttctttccttttgagaagcactgaaactcccaagtgtgttcttatcccatggataggaaaccagtgaattccgtggctggcacaccacgagctgtcacgcggcacgggtcataacacatctgggtgtcatcggacacctcacctcgcccaccctgtaggagcgtaaggagcctccatcctcagccacgtgcagctgacgtggctttcctgatcggagggcttttcttttatgggtggcccagcttcttcaagaccttcactgctctgcctcagtggacagtcgtttcttttttgaggtgtgaccttttgttttcatgccttccccttgaagtcatcctgtgttttgtaatcagctgtcaggccaaatgtctgacccgaaagagaatgtatttacactcatgctgcgttgttcagcagcccctctgtgttctgtgtgatttgttttatttttccttttttttacatatatatgcagggaagtaatggtactggtagtgtatgttttctatgtggttcaaatatgaatttcgaacacaccaagccgctaatgagatagcagcttttttctgggacccagagtcacaaccaaattgatttaagaccggacccaagacacctttaacaataggactgaaaggaaaaaggatagggaaaaagcttattaaagaaatgtgtcaacaccaaatgtagaggggaagaaccacaaccaggcataataccaaaccggttccagggggaaacaaggctttggtattccgctggctccagcgctttttctgaaacccgaggctggccagggtgctgtcaccatgcggtctttgattgcagccattcaatgcccacatgcttttccttcttgtttcagaacagcacatggtcacaacaagatattttctttccctccaaagccttttgtctccttgtgcctctttttatccttaggaaaagatccaggtgcttgtgaaaagaatcatgaatgcaacaagggaggctggtcctgttgctgtcgccgattaagttttaaacttttatttattatttatgtctgccgtattttaaataaacattctcgttccttccagtttcagtcatagtgtgtctgtggcattccagtccaaccatgtgacttatttattctaatttgagggctgcactgtacaccatggtgtcctgtgacaccgtgttccagacatttatggaaggaaaacatcccatataaatgaaactgtcatgctgtgtcctccccggcagcagaagatgtgtccttccattgagtgagggtaaccttatgtccaccaaggatactttgagaaagcccctaaggaacaagcctcagtcccacggtttcagactatttattctctgaacacaagagtattggttaattatgttctcagctctccctgctgttgtatgtgtgcattcactgcaagtaacttatatctttttatttgaatgtattttaaagcagtagatagaataacaaaggaatatgaaaaccatggactgaatggaccattttatgtattcagagagagaagccactcatcattgccagaaataccatgtaaaaattggcagttcagaggttgcaatacttagtatagtaaataaataaacggtcaacattgtgcaaccactaccaaaaagtgtgttgtaatgcatcaaaaatcaacacaattttattcactaatgagtatcaataaaataagttcaaatgatggaaaccacactggtattctgatttgtattttgtttttatcttttcatcaaggagacgatctctttatgtaagacttgaaagtgtttagctctttgcaaaattaaatgaaaggcatatacttc

SEQ ID NO: 191963 - DNA, 2008 bp, Homo sapiens
  Payload ID: 17926
  Gene Name: trafficking protein, kinesin binding 1
  ENST ID: ENST00000484786
  CDS Start-End: 423-2003
ggcacctccccgtgaaacctgccaagctggacgccacagctctgcacgacgacactttggccaactccgtgcccccttcggaggcatgcaaccatgcagtcctagcctgcagcctgggcatccctgaggaacactacataagcgaggctgtggaagatgctcccagctacagagggtaccgggatgcctgcaccattactgatgtgtgcaacagcaccgatcttccggaagtcgagatcattagcctgctggaggagcagctgccccattataagttaagagccgacaccatctacggttatgaccacgacgactggctccatacacctctcatttctccagatgccaacattgacctcacaaccgagcaaattgaagagacgttaaaatacttccttttatgtgctgaaagagttggccagatgactaagacatataatgacatagatgctgtcactcggcttcttgaggagaaagagcgggatttagaattggccgctcgcatcggccagtcgttgttgaagaagaacaagaccctaaccgagaggaacgagctgctggaggagcaggtggaacacatcagggaggaggtgtctcagctccggcatgagctgtccatgaaggatgagctgcttcagttctacaccagcgctgcggaggagagtgagcccgagtccgtttgctcaaccccgttgaagaggaatgagtcgtcctcctcagtccagaattactttcatttggattctcttcaaaagaagctgaaagaccttgaagaggagaatgttgtacttcgatccgaggccagccagctgaagacagagaccatcacctatgaggagaaggagcagcagctggtcaatgactgcgtgaaggagctgagggatgccaatgtccagattgctagtatctcagaggaactggccaagaagacggaagatgctgcccgccagcaagaggagatcacacacctgctatcgcaaatagttgatttgcagaaaaaggcaaaagcttgcgcagtggaaaatgaagaacttgtccagcatctgggggctgctaaggatgcccagcggcagctcacagccgagctgcgtgagctggaggacaagtacgcagagtgcatggagatgctgcatgaggcgcaggaggagctgaagaacctccggaacaaaaccatgcccaataccacgtctcggcgctaccactcactgggcctgtttcccatggattccttggcagcagagattgagggaacgatgcgcaaggagctgcagttggaagaggccgagtctccagacatcactcaccagaagcgtgtctttgagacagtaagaaacatcaaccaggttgtcaagcagagatctctgaccccttctcccatgaacatccccggctccaaccagtcctcggccatgaactccctcctgtccagctgcgtcagcaccccccggtccagcttctacggcagcgacataggcaacgtcgtcctcgacaacaagaccaacagcatcattctggaaacagaggcagccgacctgggaaacgatgagcggagtaagaagccggggacgccgggcaccccaggctcccacgacctggagacggcgctgaggcggctgtccctgcgccgggagaactacctctcggagaggaggttctttgaggaggagcaagagaggaagctccaggagctggcggagaagggcgagctgcgcagcggctccctcacacccactgagagcatcatgtccctgggcacgcactcccgcttctccgagttcaccggcttctctggcatgtccttcagcagccgctcctacctgcctgagaagctccagatcgtgaagccgctggaaggtgatcacgcggggcctcggcccctctctgtcctcctgggggactccctttggtccctgatccacctgcggaaggcggggcacctctgtcacgcctactcctttttcttccgcgacagccacccgcgctgctggtttgagttcctctgagggtg

SEQ ID NO: 191964 - DNA, 6510 bp, Homo sapiens
  Payload ID: 17927
  Gene Name: trafficking protein, kinesin binding 2
  Uniprot ID: O60296
  ENST ID: ENST00000332624
  CDS Start-End: 430-3174
cctttggcttccccaattgtgtgggggctgccattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcacaaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcacatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatttgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaattttca

SEQ ID NO: 191965 - DNA, 381 bp, Homo sapiens
  Payload ID: 17927
  Gene Name: trafficking protein, kinesin binding 2
  ENST ID: ENST00000440597
  CDS Start-End: 291-381
ggaaatactgaccccataaacctaaatctcacacacggttttggacgtttaaacgaatggatttaacagccttttggaattcagcctgtttgtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactg

SEQ ID NO: 191966 - DNA, 1436 bp, Homo sapiens
  Payload ID: 17927
  Gene Name: trafficking protein, kinesin binding 2
  Uniprot ID: O60296
  ENST ID: ENST00000430254
  CDS Start-End: 351-1286
gtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcacaaacttaaagaagtaggtttattcattcattcaacagatatttgttaagcactcacatagtatcttgcaccatgctaagtgctagatacaataaacaaaataaacattgtccctgcccttttaaaatgccctaatctgattgctgttttaatcatctttatgtcatataagatatcatgaataaatactttcaagtca

SEQ ID NO: 191967 - DNA, 3896 bp, Homo sapiens
  Payload ID: 17927
  Gene Name: trafficking protein, kinesin binding 2
  ENST ID: ENST00000620184
  CDS Start-End: 744-3083
ggggccgtggaggccgctgggagagtggctctcctttggcttccccaattgtgtgggggctgccattgacccggtgtcgccgcagaaccgaggtcgccgagtgatgatgttgtgaagtcgcccgcctgtccctgccacgcccgggcggttgctggcagtgggagcagcggcagcagcttcggctgctgctttcaggctgccgctgcattaggggcttcctgaggaagcgcgggcggacgacagaggatgccgaaccactccagtcatgactgtccaaagtatgataatcacatgagagtgctcgttgctacggatgtcatttgactcatcagagaaaatctgtctaaaagaaaatatccatgtgaccaaatccatttcattattgaatggcttgatggatttcctttactctgattcataccaaagctgtccttctcaaccaaagcaagaaaggatcctgcatgagtcaatcccagaatgcaatttttacatcaccaacaggtgaagaaaacctcatgaatagcaatcacagagactcggagagcatcactgatgtctgctccaatgaggatctccctgaagttgagctggtgagtctgctagaagaacaactaccacagtataggctaaaagtagacactctctttctatatgaaaatcaagactggactcagtctccacaccagcggcagcatgcatctgatgctctctctccagtccttgctgaagagactttccgttacatgattctaggcacagacagggtggagcagatgaccaaaacttacaatgacatcgacatggttacacatctcctggcagagagggatcgtgatctggaactcgctgctcgaattggacaagctctcttaaagcggaaccatgtcttatctgagcagaacgaatccctggaggagcaattgggacaagcctttgatcaagttaatcagctgcagcatgagctatgcaagaaagatgagttacttcgaatcgtctccattgcttctgaagaaagtgaaactgattccagctgttctacacctcttcggttcaatgagtcctttagcttatctcaagggttgctgcagttggaaatgctgcaagaaaagctcaaggaactggaagaagagaatatggctcttcgatccaaggcttgtcacataaagacagaaactgttacctatgaagaaaaggaacaacagcttgtcagcgactgtgttaaagaacttcgtgaaacaaatgctcagatgtccagaatgactgaagaattgtcagggaagagtgatgagctgattcgataccaagaagagctttcctctcttttgtcacagattgtagaccttcagcacaaacttaaagaacatgtgattgagaaggaagaactaaaacttcacctgcaagcttccaaagatgcccaacggcaactgacaatggagctgcacgagttacaagacaggaatatggagtgtctaggaatgttacatgaatcccaagaagaaataaaggaacttcgtagtagatctggccctactgctcatctctacttctcccaatcatatggagcttttactggggaatctttggcagctgagattgaggggactatgcgtaaaaagctgagtttggatgaggaatcttctctctttaaacaaaaagcccaacagaagcgggtatttgataccgtcaggattgccaatgacacacggggccgctctatctcattcccagctctgttacccattccaggctccaaccgttcaagtgtcatcatgacagcaaaaccttttgagtctggtcttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctgtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgaccttttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttt

SEQ ID NO: 191968 - DNA, 4157 bp, Homo sapiens
  Payload ID: 17928
  Gene Name: TRAF-interacting protein with forkhead-associated domain
  Uniprot ID: Q96CG3
  ENST ID: ENST00000361717
  CDS Start-End: 283-837
tttacaaaggccccgggcgcgagaggacgtgctctgccagccagtgggaaggcaggccgcgcgcgcgggagcgcgggaggatcggcggctcgcggtcactggtccctggctcggttccccgcaccccggggctcacacttacccgcgcggaggagcagcggccgggtgtccacccccatcctgcgcccagtctcctcgattcccctcgctctgagccgggagagccgaacagctgaagagagttcactgactccccagccccaggtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttattcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctgttatgctgtgaaatttggaattcagtattatcattttgaagtctgtaaattgtgttagtcattaacttagtcacctgttgtattctggatctacacaaaattattttaactgctcttattaatctgtgaggattaatatacaaaaagtatcctttgagatgaagtcgtgttctcaaaataaggttatattattttctttttctgcttgattttcatcttgtgttttgctttgtttttgtaaggaaccatctcttggtttggtcacatcagttcacaacagccatttgttttcaaggtcaaggctccaggcaggttgttactggtgtttgcagcctgtcagtacttgcagtactggaataggttctaggctagtgtctgcgcgtcactgtggttttagcatgggaggacttatttgagaaatactaccttacttttctatgatttctttttacagagttatagtgtgtttactcctaagatgacagttctctttgtctatattcagcatctaagacaaatatttaaacattttaaagaaccactgtgttaagtttaggattatttacttaccaaattagaagtttgacttttatgtgttatacacaatcttaaaatttcacgaattcacctttttaatagtatccatgtacataataaaatcaaagtttaattagccattttctttgaatttttttctaaataagggaaataactgttcttgggccactttacagagataaatgtatgtgaatgtttatgataaacgcttaaatatttctaaaatattaacttcaaaaaagtctttttcagttcttaaataaaaatttatttatttaagatacttattcgacttatcttaactaaggtagctatgaatgttaagtagatgaggtaaccattcagttaagttaaattgtagcattgccaggtagtgaggctcactgtacaattttccaggtaaatgaaatttcctgtagtaagaggtccgtatttttgtaacagccttttaaaaatgcttttgggaaccctccagcctcttaccaaaagaggctttaaacctcatcttgattcagactgtcagtctattcctgggcagtagtatgtgatgtccagcaccctaaccccgactccccagccctgggactattccagtagagtgaaatatttgtccctgtacaaagtggcctgaatgactgttggagttcctgtgtctggttttcctgtttattccctgtgatgcccagagtaatggcccatccaaagatgtccagatgtccatgtgctagtctccagaacttgtaactgtgttgttatgtggcaaaggggaatgaaggctgcagatggaagtaaaatagattatgctggattatctgggtgtgcccaattgatcaccggatccgtaaaagtggaagagaggcagatcaggatgtcagcgtgatgaggtgtgagacagacttgacttgctgttgctgggaggaaggggaggtcatgagccaaggaatgtggacagtctcttgaagctggaaagtgtgcattggacatctggaagccagaaaagacaaagaaatatccagaaaggaacaaagtcttgtggacaccttgattttggtccagtgagaatatgtttgacttgttaacctacaaaactttatgatgataaatttgtgttggtcgtaagccactaaatcacagtaatttgttatagcagcagatagaaaactaatatactccctttaatataaggttatctactattgattctttctaggattttagcttctggtctgatgtgggtttacagccagatcacccggcttgaattgcttacagtgtgtagtctcatggtaaaggcgttctatgagtgaagtgtatatactttaatgtgtgtatactgtcacattttgactattttggaagactttcacctctgtttcttgtctttgaggctgatgaatgtgtttctaagttataaatttaatattaagggattcatgtattattgttattgaatccaaacaatgtgttaagtaatatttagggccagaaaaatcttgtacagaataatgatttctcctaatgtaaatcttggaaagggttttgttcaacttgagaaatattaaattttttattctattttcttttcttcaaagattggcaaaggagagagtgggttgctaaaagtttatattgttctccaaagaatagaaacactttccatagcccaactccggtagtaaataataatgaacgctttaataatgaaagagcaattggttagtattagaattgttttgattacaaagttagcatctctgcctgagctacccaaccccaaagcggggttgttagaggaaagctaccatatttcatagaaccgaggaaggaatgcagcagacctcaggtgagattcgaatgctctggctctgaccctcaatgcatattggctccatggccacctgtagctcccaagttttacacgttattgatcccccaaagagacctgatctcttgatttcagttccagggacgggtcagcttgggtcaggtgcccaccccttcaccaatcaacttgtctcaggtaacgcagtcacattatataatggctgctctggtcagtgatcatgtggatagatacagcattttctcaaaaaaatggtcacaggggtgggggtggggcaaacaaaaatattggtgtttgatacaaggtactgaagctaagatgtgaaaccttccatatacactttaaggacttctttgtccctggaaagtgatttttctggggctccttaggtagagaggtgtattaatggtgccagtgttagaatccttggcagtctcttcttgaacctgcaactccagtggttaaatctcataggccatataaccattttctagagaattctgttcctactatctaatgcagtaactgacttaaaagtaagtattactgttagactctaacataagtggtggtatttgttttaatggaggtgggatcaggtatgtgttcacttaagctttacattaaaaaaaaatttatatgtgtaaataaatatatatgccttgtagaaaaattagccataatcttactaccagaagagaactactgttaactttgtgtgtgtgtatatgtggtggatggttttatgttacctcctggctctttttatgtttccaattctctaacacttgtttaattaattacttatattattaa

SEQ ID NO: 191969 - DNA, 769 bp, Homo sapiens
  Payload ID: 17928
  Gene Name: TRAF-interacting protein with forkhead-associated domain
  Uniprot ID: Q96CG3
  ENST ID: ENST00000500655
  CDS Start-End: 112-666
gactgagctgctccttgtgggaactgctgatgttttgacaaaagaaagagggaaggtggaactacacagtggcttttaagtttctgcttggaagtgggccttgtgcacatcatgaccagttttgaagatgctgacacagaagagacagtaacttgtctccagatgacggtttaccatcctggccagttgcagtgtggaatatttcagtcaataagttttaacagagagaaactcccttccagcgaagtggtgaaatttggccgaaattccaacatctgtcattatacttttcaggacaaacaggtttcccgagttcagttttctctgcagctgtttaaaaaattcaacagctcagttctctcctttgaaataaaaaatatgagtaaaaagaccaatctgatcgtggacagcagagagctgggctacctaaataaaatggacctgccatacaggtgcatggtcagattcggagagtatcagtttctgatggagaaggaagatggcgagtcattggaattttttgagactcaatttattttatctccaagatcactcttgcaagaaaacaactggccaccacacaggcccataccggagtatggcacttattcgctctgctcctcccaaagcagttctccgacagaaatggatgaaaatgagtcatgaacacagaaagtctaagaggagaaatatgatggatgaagagctctgtagatgctgtatagacactaaataagagttgattagggtagtatattatagtcatctg

SEQ ID NO: 191970 - DNA, 5923 bp, Homo sapiens
  Payload ID: 17929
  Gene Name: TRAF-interacting protein with forkhead-associated domain, family member B
  Uniprot ID: Q6ZNK6
  ENST ID: ENST00000537858
  CDS Start-End: 202-687
ctgcaatgaaaaattacacttctattttctttcctaaagggaaaaaggaagaatgcaacaaaactgaagtatgttctgccacgttcctgaactgcagccataggagccctcccagccctacccaaaccagcctactccctctcaagagctcacagctgcaggactagagccagatgtgccccggcaataaggacttcttccatggagaagcccctcaccgtcctgcgagtgagcctgtaccatcccacgctgggcccatctgcctttgccaatgtcccaccacggctgcagcatgataccagccctctgcttctcggacgggggcaggacgcccacctccagctgcagctccctcgcctctcccgccgtcacctgtccctggagccctacctggagaaaggcagtgccctgctggccttctgcctcaaggccctgagccgcaagggctgtgtgtgggtcaatgggctgacgctgaggtacctggagcaggtccccctgagcaccgtcaacagggtctccttctcaggcatccagatgctggttcgcgtagaagaaggcacatccctggaggcttttgtctgctatttccatgtcagcccttcacccctgatttacagacctgaggctgaggaaactgacgaatgggaaggcatctcccaggggcagcctccccctggttcagggtagcagatccaggttgcctggggtttctccacggcccttcccagacttgggacagccctctccagccaagacctggaggaggaacagaaatacagctccagagggaacccccagacagtgcactctgctagccctgccactagagcaagcctttgctagatgaaacaggatttgaaatacttgagctgcatcatgcaaggttgacaagcaaaacccactggctgccttgctcataatgaaccaattctgcaaacaccgaacaaacagcccaggggggagaagcaccctctgtggccagagctatgcaatgtaatgggaacatcatatacttttagaggccctgaggggttctggggagcctctctcagcatttccacacatttctccctgttgtctgactaggagttactttatgtggttcattttgtgtgctgcttaagagcaggagtttgaggttgcaccaggaatgcgtggacacatgtaacaattacatttgtggtagcttggggttaccttcagctttcaaatacccacaggcacgcggggcttaggaaagcctgagtgtaataaactgcaagtatttcattaagctggcatacccaataggattccctgatccccagatgggccacatgcacgccacgctgtcatgcagacgtgggggtgggaaatatagacgaggtgtaagaggaaattggaaaggtgggactcacatttctggaaaggatgcaggcagggctcagggtttcctgaggatgggagctgggagctgggcctgcctggaaattcattgtcccccttatcatcctcatcctcacactccgcattctctgtcacttctggatcaaggccttggttgacttgagggcaaggtctttagggaatgaggggatggggtgggggtttgtgtaagaactcagcccagcagttatttcgctcagggtgagtcacacaccaatgggggtgggggaattccttccaaataagggactcgttaggagccaggtacgccaagggcaggaggattttctcggtgaacaagggcagcagctatttgccacgccatgctgagaaggggagagtgtggtttagaaacaacgttcactagtgtgatgcagggagggatctacatggtcaccatgatcccagaccccactctccagggaatctgaggcaccaagggcacagccctgttcccctggctgactcgaatctctgggtctgtagctgtcaacaatttctgttttctgcccaaaaggatgatcgttttgcacccagggcaagctacaaggaggtccaacttcactcacaggccctgagcatcttctccatcaggaaaacagaggtgggcaagacccaggcttgccctggtgtgggaagcttcctctccaatagggatgaagcaaaaacactcagatcacagccacaaggcagggagagcagggctgctaggaaggggctctctgatgctgtgaatgaccccttgggacccccaaagcagttcctcattcattcagcaaaccttcaccaagcacccaccttgtgccagatctgtgcaaagccacggaactgaaccagaagtgaataaggcaaactccctcagggagtttaccttgcactcaggaaagtcaagcattcaggagtgcattacttatttgatcactactatgattagtgctatagtcattgtatttttctctctcctccagctgggctcacattctcttgttaagtggccttgcctgttgagtgcctaccatgtgcttagcactctgctaggtgctgtgtgtattaactgcacttaacagataaggaaactgagacttggaaaggttacatatcttgcccaacatcacaccatcagtagctatgcgatttgggcaagtgatttagtctgctcttgcctctatttctcccgctggaaaatgggtaagataatagtactacctgctagagttacgagggtcttagaaggtgacacctgtaaagcattcaatcagtgcccagcacacacttaataagggttagctactatcatgagacctgagagaggagggctcaccatccacacggagctaaggaagactcacaccccagtaagctggctccagaacccaagggcttacctgtgctctgtgattccccaactagggatttagttgtagccacggacctggtaggcaacagggaggggattttaatctgctccttgcatcagaaggtccaataggcagggttagtataatgggagatgccctggtagggctggcaaggagaagaagccacatgtattttggtctgatgaaaagcagcagtgatctgtcactgaccaaaatggtcccccaactatgcattacggagcagcaacccacatacagaactcgagaagccacggcctggagactgtacctggacaccaaagactggagagaggagctggtggggaaaccccagagttcccagggtgccactccccagctccaccagagaactttgggaatgagctgctgcccctgagtgcccctctccagggcctcagtgagggtctctaccctccagggaggaacaaaaccttgccagctggggtcctgcgagagggggcagttcaattcctccacaggggactctgcaactccaatctttcgagtgaagcatctgcgaggccctcagggacccaggatgaactgcatagcagcagaaggaagacaggccagaccaggcgggagggagcccggaaacatctggtttgtagtttcagactctacccgttcacagttcacacagtctcaccgggaaactcacaccttgccctgtaccaagtttttaaggcagttaagctctgcccatccgagacttcatttttcttgagtagaaaatcactgaaatcatcagatccatggcacccaccttcactttctcctaacagctggaaccgtcaggctggcttcagggcctggtcttcgcacttgatatcactatccctcacctgctcagacagccagagcaggcgggtgagttcctcccaacaacctccactgcattctctcagctcccaccgcagggcagcccacgtgcctgagtgaacatgtgtgcgtgtgcacacacgcaagtatgcacagacatacactaaacacgaacatacagtgcacatgaacgctgctcccagctagggccctctggtcagactgctgcctgggttagaattcttgtccccacccccacttactatagttctgtgatcctggacaagtaactgaatctctccgtgccacagtttcttcttgtagaaaacgggaaagttcacagtacttacctccttagagtcattgtgaaggtcagtttgaggcatcacaaatttaaggcacccagacataagggtcaacagggttagctatcactgtccagtttggtgggaggaactgaatgcatgtaggcacatggacccagtctacactcaggcacaaaaggagctacattagttacattcaggcataccccagagcactacaattctctgagacattgtctggaaatctagaaatcatctccttgccctttaaggtattttaaccctcgcattcctctgcttttccaagaatgtgaatcttgccaagctgtccgtgagagacacgggctcccctcgagggagacttgcaaatgctccataaacagccacagtgtggggctctgccatgaggaagtcacagcagacacgctagacagcatagtcctggatgcaacctggaggaagggaggcccatggtggagcactcactccgtgcctgtctgcccggtgagacctcaagttccttgcagacaaaggccatgggttgttggctcttgtgttcccggtggcctttccagagctgaacagaggacagatgcacagacgggggggctctggtggtcaaggcagcagtccccttggatactaaagtctgagccaggcccctcaggcccggcatgggcagtgcgaggcccatagtggtgggaagccagttggccagctggggtgagaaggccgcgaagccatgggcagacaggaagtggaggtgaatgtctctgcctcctgtaggcctcagcagggacagcacagaccctctggctggggcagcgcagaccctctagctggggcagaacaaggctggtgcttccttctagtccttgagactttgtagctctaactcaagcagaaccctggggttttgggattctgtgtggtgactgctgaggaaggtttatggatttgacagggtgcatgtcacagagagacagttctcagtcagcacttcctgtcccctgcagaggctcataggggacagcccctgccaaggagaccctggaggggctctgaggatagcaatcagaggttgggctggctggactgagcccaggcctgttgcccaccaagtctccataggttctagtctgacccctctctccacccctgggctatgcaggccagcccgtgcagaccacccccgacgcgtccacttgcaacacccgcctcactgtgccaacactccatccacacaggaaaggactgagaacgtgatgcttaacccaaaggagtgagtttcataggatgggtggctttaacagtttcacagcaggacactgagggaatatttccctatcccttcaaatggacggtcactacagaaacgtgtagagcaagactttgtcaaggggctgtttccaggtctcccggtgtctaaatagcagagctggaatgggaactgagaaccgattctttccacaaccgcccactgagcagcaaggctgcagccagcaaagaggtgcggaggcaagcaagctccatgtggtggggacagcgcattgcgacctccaccacccctgcagtgggctgccagctgagccacctgtcttccactgtatctactgtacgaacttctccagctctgctctgttttctcttcctcagcatccaccccgtgacacgtagtggtggctgatgtcgccacagtaccatgaggttaacaggtcctccctccagcttccctcatggtggcagcctaacctgcattgcagccgttcaccggacaccgcaccagaccctcaaaacccatccaagactgtgggaggagtaaacaacccagcccagttaagaggagatgccgaatttaatgaaccctatttgaattgcagggctgtgattcctcttacctttaacgtgaactcacaggcggattaaagtgaaataaaacctaccatttga

SEQ ID NO: 191971 - DNA, 3178 bp, Homo sapiens
  Payload ID: 17930
  Gene Name: TRAF-type zinc finger domain containing 1
  Uniprot ID: O14545
  ENST ID: ENST00000257604
  CDS Start-End: 618-2366
agtgcggggtctgacagaggaggctccgtgtctgcagctagtgtgtcaactcagcgtttctcctctcgtccctggtgaggtgtagcggcggcacgcggctggagatcccctgtggcctccagtttaggaagggtccagcatcccaagggaggggtgtgtgggcgaggggtctctgggcccggggtcgcggctgtgaggagaggatgcccgcgcggcggcatctcaggcacctggaggaggccgcgctttctcctcagggaaccggcgccttggcagcccccggcgacgccgcccccttcgcggcctaggttggtctggtgagccgggaagcgggcgtcgttcgcagcgccgctgtgaccaccgcgtcccgggcggagctgggctcagtgccggcctgggcctagagtccgagcctcgagctgccggcgtggggggtcgcgagtggcctaatgcggcctcgaagccgaaggacccgagtccgagctcgcactccgacccgctggtgctgtggaaaactcaggtggccttccgctttcgtagcctctaaagtggggaccaagactttcacctcttaggattgtagtcgggattaaaagattttcccggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttc

SEQ ID NO: 191972 - DNA, 2697 bp, Homo sapiens
  Payload ID: 17930
  Gene Name: TRAF-type zinc finger domain containing 1
  Uniprot ID: O14545
  ENST ID: ENST00000412615
  CDS Start-End: 131-1879
cgcgatgggcggaagtggtgaggcagctctgagggccgttgttcagtgcggggtctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattcctagactggattcccagcctcaagagacctcaccagagctgcccaggaggcgtgtcagacaccagggagacctgtcttctggttacctggatgatactaagcaggaaacagctaatgggcccacctcctgtctgcctcccagccgacccattaacaatatgacagctacctataaccagctatcgagatcaacatcaggccccagacctgggtgccagcccagctctccttgtgtgccgaagctcagcaactcagacagccaggacatccaggggcggaatcgagacagccagaatggggccatagcccctgggcacgtttcagtgattcgccctcctcaaaatctctacccagaaaacattgtgccctctttctcccctgggccttcagggagatacggagctagtggtaggagtgaaggtggcaggaattcccgggtcacccctgcagctgccaactaccgcagcagaactgcaaaggcaaagccttccaagcaacagggagctggggatgcagaagaggaagaggaggagtaatggtgtctccagagactttacatcggttcctgtcttctgtgcacagcagcacttgccgctgtgcaggcccacctctttggctctttgggtgggagagtttttccagattttagatttttctaggttatggccattttgtgtcttttgaggttgtgctgtgggggtttgggtttgagggaagggagcagggtggcggttgaggaacgcttcagccttagctgctacctttcggcagcagtgaaatacaagctgcagcctcggctgccagggctcccttttgacttattgtcgccactgccccttggtgctgtgtggtcccagtggaaggaggggaagattttggaaacctggtagccaccagtaaggtgattctctgccctgttggggcctaaatttgggggcttttgggcaacctctccgtgtactgcgtctgtccacactcgattgggccccaggtgtgtatgaggcgctctggtaaggtgctcaggccagttgcaatgtctgtcagtaacgaggcttttgatgtgttgagctggaggtgagtggaccgggggctgtgttttaagctgcttccttggcatttggcatcactgccttctgttcccgggggagcatggatcttttgtcctcactgctttctaatggggagggctgagggctccctgtccccacagcaggtatgttgggctctgccccagccccacacttgctctgaaaaccaagtgtcagagccccttccccttgtttttattttactgttataataattattaacttccttgtaatagaaataaagtttgtacttggagttcagctca

SEQ ID NO: 191973 - DNA, 1043 bp, Homo sapiens
  Payload ID: 17930
  Gene Name: TRAF-type zinc finger domain containing 1
  Uniprot ID: O14545
  ENST ID: ENST00000552890
  CDS Start-End: 72-566
agaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaattgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagggtgcagctgacgagatcatgttgccttgtgaattttgtgaggagctctacccagaggaactgctgattgaccatcagacaagctgtaacccttcacgtgccttaccttcactcaatactggcagctcttcccccagaggggtggaggaacctgatgtcatcttccagaacttcttgcaacaggctgcaagtaaccagttagactctttgatgggcctgagcaattcacaccctgtggaggagagcatcattatcccatgtgaattctgtggggtacagctggaagaggaggtgctgttccatcaccaggaccagtgtgaccaacgcccagccactgcaaccaaccatgtgacagaggggattccta

SEQ ID NO: 191974 - DNA, 867 bp, Homo sapiens
  Payload ID: 17930
  Gene Name: TRAF-type zinc finger domain containing 1
  ENST ID: ENST00000547063
  CDS Start-End: 78-362
tctgacagaggaggctccgtgtctgcagctagtgtgtcaactcagcgtttctcctctcgtccctggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggtacttaagactgaattggaggccgggcgtggtggctcaagcctgtaatcccagcactttgggaggctgaggcgggcggatcacaaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtg

SEQ ID NO: 191975 - DNA, 532 bp, Homo sapiens
  Payload ID: 17930
  Gene Name: TRAF-type zinc finger domain containing 1
  ENST ID: ENST00000549358
  CDS Start-End: 128-532
agtgcggggtctgacagaggaggctccgtgtctgcagctagtgtgtcaactcagcgtttctcctctcgtccctgaaatgaaagagaaagttcatgtcttcctttgtggttttcaggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgt

SEQ ID NO: 191976 - DNA, 983 bp, Homo sapiens
  Payload ID: 17930
  Gene Name: TRAF-type zinc finger domain containing 1
  ENST ID: ENST00000552896
  CDS Start-End: 134-983
ggaggctccgtgtctgcagctagtgtgtcaactcagcgtttctcctctcgtccctgcctctaaagtggggaccaagactttcacctcttaggattgtagtcgggattaaaagattttcccggaagagctaaagatggctgaatttctagatgaccaggaaactcgactgtgtgacaactgcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtggtgcccggacggaactatgtggcaactgtggtcgcaatgtccttgtgaaagatctgaagactcaccctgaagtttgtgggagagagggggaggaaaagagaaatgaggttgccatacctcctaatgcatatgatgaatcttggggtcaggatggaatctggattgcatcccaactcctcagacaaattgaggctctggacccacccatgaggctgccgcgaaggcccctgagagcctttgaatcagatgttttccacaatagaactaccaaccaaaggaacattacagcccaggtttcaattcagaataatctgtttgaagaacaagagaggcaggaaaggaatagaggccaacagccccccaaagagggtggtgaagagagtgcaaacttggacttcatgttggccctaagtctgcaaaatgaaggccaagcctccagtgtggcagagcaggacttctggagggccgtatgtgaggccgaccagtctcatggcggtcccaggtctctcagtgacataaagg

SEQ ID NO: 191977 - DNA, 584 bp, Homo sapiens
  Payload ID: 17930
  Gene Name: TRAF-type zinc finger domain containing 1
  ENST ID: ENST00000548092
  CDS Start-End: 367-584
gacagaggaggctccgtgtctgcagctagtgtgtcaactcagcgtttctcctctcgtccctggaagagctaaagatggctgaatttctagatgaccaggaaactcgactgtgtgacaactgcttagatatgatctttgaaccactaaactaagtgagaaaggcaaaaatgaagtggagagaccagactggtggaggaaagggttcaggatttcatttttgtacagctttacagtgaagtttctaccaacccagccagagagcatgttcctgtagtcaggaagcatccagcctgcttcgaaagcaaaaaagaaattcctgtgtttaactttaccatccatgagatccactgtcaaaggaacattggtatgtgtcctacctgtaaggaaccatttcccaaatctgacatggagactcacatggctgcagaacactgtcaggtgacctgcaaatgtaacaagaagttggagaagaggctgttaaagaagcatgaggagactgagtgccctttgcggcttgctgtctgccagcactgtgatttagaactttccattctcaaactgaaggaacatgaagattattgtgg

SEQ ID NO: 191978 - DNA, 1171 bp, Homo sapiens
  Payload ID: 17931
  Gene Name: trans-2,3-enoyl-CoA reductase
  Uniprot ID: Q9NZ01
  ENST ID: ENST00000215567
  CDS Start-End: 138-1064
gcggcctggaggggcggggcggacgcagagccgcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcg

SEQ ID NO: 191979 - DNA, 541 bp, Homo sapiens
  Payload ID: 17931
  Gene Name: trans-2,3-enoyl-CoA reductase
  ENST ID: ENST00000598715
  CDS Start-End: 147-541
gacagacacccctgcacacggttgagccctttgtaggtctccgtgtgacaagtacatccctgctgtgcttgggaaagggctgcggcttgggaaagggctgtgtgggttccctggcttcttcctgctgtccccgaggagcatcggaaatgggtcacaacgcagcaggtggagattctggacgcaaagacaagggagaagctgtgtttcttggacaagagctgacgtccctgcgcctgtgcttcccccaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttac

SEQ ID NO: 191980 - DNA, 735 bp, Homo sapiens
  Payload ID: 17931
  Gene Name: trans-2,3-enoyl-CoA reductase
  ENST ID: ENST00000594545
  CDS Start-End: 606-735
gctctgtgcagggcgggggctgggaggtgttgtcatgcctgcccctggggctttccctgtgctggtgccgttgagggttttgaggtgaccactcaaaagctgctttcagggcagcctggctccccggggagactcccaagcccccctcagagaaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcg

SEQ ID NO: 191981 - DNA, 868 bp, Homo sapiens
  Payload ID: 17931
  Gene Name: trans-2,3-enoyl-CoA reductase
  ENST ID: ENST00000598298
  CDS Start-End: 728-868
cggacgcagagccgcgtttagtctatcgctgcggttgcgagcgctgtagggagcctgtgctgtgccgcgcagttaggcagcagcagccgcggagcagtagccgccgtgggagggagccatgaagcattacgagatgagactcaaagcaatgagcccagcagcaactggaaaaacagctactacatcttgtaattgagcctgttaattcctgagaaaatcagtctgtcttcagcctccagcagtccagggatatcaggctgacatctctaagtcacaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtg

SEQ ID NO: 191982 - DNA, 1204 bp, Homo sapiens
  Payload ID: 17931
  Gene Name: trans-2,3-enoyl-CoA reductase
  ENST ID: ENST00000600083
  CDS Start-End: 634-1095
gtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaagtacctccccatcctgagtctgggctccccgcagagctgacgtccctgcgcctgtgcttcccccaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcgga

SEQ ID NO: 191983 - DNA, 1202 bp, Homo sapiens
  Payload ID: 17931
  Gene Name: trans-2,3-enoyl-CoA reductase
  ENST ID: ENST00000598987
  CDS Start-End: 103-282
tttagtctatcgctgcggttgcgagcgctgtagggagcctgtgctgtgccgcgcagttaggcagcagcagccgcggagcagtagccgccgtgggagggagccatgaagcattacgagcagagagatgattcttcaagaaaccaaagcagcctgtggcattccagcgattcctcattgctcaagggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtc

SEQ ID NO: 191984 - DNA, 1170 bp, Homo sapiens
  Payload ID: 17931
  Gene Name: trans-2,3-enoyl-CoA reductase
  ENST ID: ENST00000596073
  CDS Start-End: 603-1064
gcgtttagtctatcgctgcggttgcgagcgctgtagggagcctgtgctgtgccgcgcagttaggcagcagcagccgcggagcagtagccgccgtgggagggagccatgaagcattacgaggtggagattctggacgcaaagacaagggagaagctgtgtttcttggacaagagctgacgtccctgcgcctgtgcttcccccaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtc

SEQ ID NO: 191985 - DNA, 559 bp, Homo sapiens
  Payload ID: 17931
  Gene Name: trans-2,3-enoyl-CoA reductase
  ENST ID: ENST00000601187
  CDS Start-End: 1-453
agacgctcttcgtgcaccgcttctcccatggcactatgcctttgcgcaacatcttcaagaactgcacctactactggggcttcgccgcgtggatggcctattacatcaatcaccctctctacactccccctaatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtc

SEQ ID NO: 191986 - DNA, 314 bp, Homo sapiens
  Payload ID: 17931
  Gene Name: trans-2,3-enoyl-CoA reductase
  ENST ID: ENST00000598918
  CDS Start-End: 112-228
ggtctccgtgtgacaagtacatccctgctgtgcttgggaaagggctgcggcttgggaaagggctgtgtgggttccctggcttcttcctgctgtccccgaggagcatcggaaatgggtcacaacgcagcaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaccctggcccgcctctctgcagagggcaagtccctga

SEQ ID NO: 191987 - DNA, 822 bp, Homo sapiens
  Payload ID: 17931
  Gene Name: trans-2,3-enoyl-CoA reductase
  ENST ID: ENST00000598333
  CDS Start-End: 62-379
tgctgtgccgcgcagttaggcagcagcagccgcggagcagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcc

SEQ ID NO: 191988 - DNA, 3573 bp, Homo sapiens
  Payload ID: 17932
  Gene Name: trans-2,3-enoyl-CoA reductase-like
  Uniprot ID: Q5HYJ1
  ENST ID: ENST00000381210
  CDS Start-End: 112-1203
gcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggccctctaagaccaactccagcagtcaaacattcaaaaacgactcactttgagattgaaatatttgatgctcaaacaaggaaacagatatgtattctggataaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagtgtttttggctgaatacacaggacctctgctaatatacctcctcttttatttgaggatcccatgtatatatgatggaaaagagagtgctagaagattacgccacccagtggtacacttggcttgcttctgtcattgtatacactacatccgataccttttggaaaccttatttgttcacaaagtttctgcaggacacacacctttgaaaaatttgataatgagttgtgccttttactggggatttacttcttggattgcctactacattaatcatccactatatacaccaccatcatttggaaacaggcaaatcacagtatctgctatcaattttctgatttgtgaagctgggaatcatttcatcaatgtaatgttgtctcatcccaatcacacaggaaacaatgcctgtttcccaagtccaaattataaccccttcacatggatgtttttcctggtttcatgtcctaactacacctatgagattggatcatggattagtttcacagtcatgacacaaacactgccagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaaatctgattaacaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctacagagagccatgattaaaccaaggcactccagcctgggtgacagagtgagactgtctcaaaataaaataaaaataacatattggtgaagatgcgggaaaaaaaaaagaactcttagacactgctggtgggaatgtaaactagagcagccatgtggagaacaacatggactttcttcaaaaattacaaatagaactatcatatgatccagcaataccattactggaaaaaggaaatctgtatattaaagagacatttgaaccctatgtttactgcagcactattcacaatagccaagatataggagcaacctaggtgtccaacaacagatgaatggataaagaaaatgtggtatatatacacaatagaatactatgcagccataaaaactgaattcctgtcattcaggacaacatggatggaattggagggcatatgttaagtgaaacaagccaggaacagaaagttaaacattgcatgttattacttatatgtggaagctaaaaaaattgatatcatagaagtaaaaaataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgaccactataaattatatgtattgaaacattattatgtatctcccaaatatgttcaattcttatgtcgctcaaaaaataaaatttaatttaaaaagtatctgatttttaaagtaaatattttttaaagttttgacatttaaattacttgaatctcattattttgacaataatttaattcttttattgttcaatctgttagtgagatgtgtcataggtattatgtcattagttcaaattcttgcggaaattatagctatattaaaagtgtaacatttttatttagttgtgtacttatttgttaataatacagacattgtatgttatcatactgaaatttacaattaaaatattttctgtagattatttgaaaatcattctaaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgtatgcacttgcaaagcaaaagtacattggtaatttgggcacattcagagtggaaaaaatttgttctatttttacatctttaaatacctatcttctatgaaagcctatgtgcatgtgtgtgtgtgtatgagtttctatgtgagcatgcatatatacttcacaaagagatgacctatataaatcaaagtacacattatttaaaatatttaaaaaaattttcagtttcttcatttttaaattgtgatttttagatttgttagtctatggagtattttcaattctcagattatacatatgttataaaatatgttcattaaa

SEQ ID NO: 191989 - DNA, 484 bp, Homo sapiens
  Payload ID: 17932
  Gene Name: trans-2,3-enoyl-CoA reductase-like
  ENST ID: ENST00000509536
  CDS Start-End: 48-484
gcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggccctctaagaccaactccagcagtcaaacattcaaaaacgactcactttgagattgaaatatttgatgctcaaacaaggaaacagatatgtattctggataaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagt

SEQ ID NO: 191990 - DNA, 188 bp, Homo sapiens
  Payload ID: 17932
  Gene Name: trans-2,3-enoyl-CoA reductase-like
  ENST ID: ENST00000511997
  CDS Start-End: 1-84
ccaaattataaccccttcacatggatgtttttcctggtttcatgtcctaactacacctatgagttggaatttttacacttctgatgagtatccagatgtctttgtgggcacaaaagaaacataagatttatctgagaaaattcaattcatatattcatagaaaatcagcaatgattccattcatattg

SEQ ID NO: 191991 - DNA, 2876 bp, Homo sapiens
  Payload ID: 17932
  Gene Name: trans-2,3-enoyl-CoA reductase-like
  ENST ID: ENST00000507440
  CDS Start-End: 118-1098
ggaatggcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggccctctaagaccaactccagcagtcaaacattcaaaaacgactcactttgagattgaaatatttgatgctcaaacaaggaaacagatatgtattctggataaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagtgtttttggctgaatacacaggacctctgctaatatacctcctcttttatttgaggatcccatgtatatatgatggaaaagagagtgctagaagattacgccacccagtggtacacttggcttgcttctgtcattgtatacactacatccgataccttttggaaaccttatttgttcacaaagtttctgcaggacacacacctttgaaaaatttgataatgagttgtgccttttactggggatttacttcttggattgcctactacattaatcatccactatatacaccaccatcatttggaaacaggcaaatcacagtatctgctatcaattttctgatttgtgaagctgggaatcatttcatcaatgtaatgttgtctcatcccaatcacacaggaaacaatgcctgtttcccaagtccaaattataaccccttcacatggatgtttttcctggtttcatgtcctaactacacctatgagattggatcatggattagtttcacagtcatgacacaaacactgccaggtggtctcactgcctaagacatcaaaagaaaaagcctgacaaatttacaccatcttgttgtcaatattaatgctacaggtataatcctgtagcagccatgtacacatttttagcctttaaaacctaaccttcatttacaggttttaggagttactatacataagtatgtacacatatgcatatgtatatgggtatgtgtgtaaatgtgcacacttacaaactttaatgatactctaaattaatatataagatttatgtaaataataagtttgcattgctggctaaaatattgtgcatttattttaatataaaacaaatctatataatctcacatattcatggttttttgccacatatctaagtaacttaattttagcttatggagtattttgcaggagcagcattcaacactgcatagattagttgtaagtgtctcaattacatttacatatcagtgtgtttggtggggaaagaagatgaaaaataaaacatttgaatataaaattaaaataaataaaatatgacatttatttatgatagatgtcataatttgatcatattcataggaaaaacattaatgaaaaatttaaatgcagaaaaatatatacacacattatacaaattaacaataacattactaccacagttacttattgaagtaatatgctgtctttaatatgtttcattataccatgttctctcagagttaacactctcatcctataaataaaagatatattctcaaattctaaaattcttgtgtgtgtattttcaacagttgttatttttaggtcaagaaaaatattatgacaatattagcaactgttaaattctatgctttgagacgtataggcctcatttctaatttaataaggtatgtatatatttgatattttcataaaagcaatacagggtttggccaagaagttttgccgtctgtgaaaggcatgcatttgatgctattataagccatattaactggagaacatttctaaaatacctccatttcacatgcaaattttatactctatatattgatggatttgtttatgagattgagagtcagatgtagcaattggtgagagaggaaacagttacaaggcagcctctactttttagatagttcgcttgtttaagagacaaaacaagttcaactttaattgaaatattgcatatttgcttgcttaattactgttaaaccttaaattaaatattctttataataagcatgtcttcgaacatgaaataaaattaacaagtctgagagtgaaacttttcccattatgagagacattttagtcagcctcatcacaagaagacttttgctttcctcaaaccatcccatatttctttttgacacttgaaagtatgcctctgcttcctgtatttcttttaaacattctggagcttttgttgttttgttgtaactgttgccaaatttataattgttagatgacaaatgtccttaacaagtgtttttcagtaattgtgcctaaagaaatacaattataattgccatcaaactaatttggtatgcatgcttttacctcccaaaccataaattgtcctcttccttcaggacactgtaaaccttgaattagaatcaaatcaacaatttccattattgtaatgtagaaatcagttcattttttaaacacaggaatcaaagactgcctggcttacatatcctaaacagttttaatatgaaaaaaagatatataaatgtttagaaaaaaaattagtagaattaattaaaatcaattagaatatgtgtattaaaagcaatattaagttg

SEQ ID NO: 191992 - DNA, 1346 bp, Homo sapiens
  Payload ID: 17933
  Gene Name: transaldolase 1
  Uniprot ID: P37837
  ENST ID: ENST00000319006
  CDS Start-End: 154-1167
cccgggggcggggcttcgtccaggcgcgcagggaccagcgggcctcgccctcccgcgccgctttccgattggcagccgcccgcggggcattgtgggccgtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttca

SEQ ID NO: 191993 - DNA, 710 bp, Homo sapiens
  Payload ID: 17933
  Gene Name: transaldolase 1
  ENST ID: ENST00000530440
  CDS Start-End: 29-310
ccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcggaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactg

SEQ ID NO: 191994 - DNA, 856 bp, Homo sapiens
  Payload ID: 17933
  Gene Name: transaldolase 1
  ENST ID: ENST00000528070
  CDS Start-End: 68-220
gcattgtgggccgtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgtagagatggggtttcaccgtgttagccaggatggtctggatctcctgacctcgtgatctgcccgcctcggcctcctaaagtgctgggattacaggcaccagccaccgcgcccggccgtctacttgcttttctaattgtgggtcctaagaccctcatttcaaaaggggtcccatcacataccctggaggaaggaatgttgcacggaggacgccatcgacgagtacaagccccaggatgctaccaccaacccgtccctgatcctggccgcagcacagatgcccgcttaccaggagctggtggaggaggcgattgcctatggccggaagctgggcggaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctgg

SEQ ID NO: 191995 - DNA, 1231 bp, Homo sapiens
  Payload ID: 17933
  Gene Name: transaldolase 1
  ENST ID: ENST00000528097
  CDS Start-End: 55-1011
tccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatggccggaagctgggcgggtcacaagaggaccagattaaaaatgctattgataaactttttgtgttgtttggagcagaaatactaaagaagattccgggccgagtatccacagaagtagacgcaaggctctcctttgataaagatgcgatggtggccagagccaggcggctcatcgagctctacaaggaagctgggatcagcaaggaccgaattcttataaagctgtcatcaacctgggaaggaattcaggctggaaaggagctcgaggagcagcacggcatccactgcaacatgacgttactcttctccttcgcccaggctgtggcctgtgccgaggcgggtgtgaccctcatctccccatttgttgggcgcatccttgattggcatgtggcaaacaccgacaagaaatcctatgagcccctggaagaccctggggtaaagagtgtcactaaaatctacaactactacaagaagtttagctacaaaaccattgtcatgggcgcctccttccgcaacacgggcgagatcaaagcactggccggctgtgacttcctcaccatctcacccaagctcctgggagagctgctgcaggacaacgccaagctggtgcctgtgctctcagccaagcccaagccagtgacctggaaaaaatccacctggatgagaagtctttccgttggttgcacaacgaggaccagatggctgtggagaagctctctgacgggatccgcaagtttgccgctgatgcagtgaagctggagcggatgctgacagaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcc

SEQ ID NO: 191996 - DNA, 1582 bp, Homo sapiens
  Payload ID: 17934
  Gene Name: transcobalamin I (vitamin B12 binding protein, R binder family)
  Uniprot ID: P20061
  ENST ID: ENST00000257264
  CDS Start-End: 106-1407
gaaaagaggctgaggcaacctgaaggaggagctctcattaccttctgcccatcacttaataaatagccagccaattcatcaacattctggtacactgttggagagatgagacagtcacaccagctgcccctagtggggctcttactgttttcttttattccaagccaactatgcgagatttgtgaggtaagtgaagaaaactacatccgcctaaaacctctgttgaatacaatgatccagtcaaactataacaggggaaccagcgctgtcaatgttgtgttgtccctcaaacttgttggaatccagatccaaaccctgatgcaaaagatgatccaacaaatcaaatacaatgtgaaaagcagattgtcagatgtaagctcgggagagcttgccttgattatactggctttgggagtatgtcgtaacgctgaggaaaacttaatatatgattaccacctgatcgacaagctagaaaataaattccaagcagaaattgaaaatatggaagcacacaatggcactcccctgactaactactaccagctcagcctggacgttttggccttgtgtctgttcaatgggaactactcaaccgccgaagttgtcaaccacttcactcctgaaaataaaaactattattttggtagccagttctcagtagatactggtgcaatggctgtcctggctctgacctgtgtgaagaagagtctaataaatgggcagatcaaagcagatgaaggcagtttaaagaacatcagtatttatacaaagtcactggtagaaaagattctgtctgagaaaaaagaaaatggtctcattggaaacacatttagcacaggagaagccatgcaggccctctttgtatcatcagactattataatgaaaatgactggaattgccaacaaactctgaatacagtgctcacggaaatttctcaaggagcattcagcaatccaaacgctgcagcccaggtcttacctgccctgatgggaaagaccttcttggatattaacaaagactcttcttgcgtctctgcttcaggtaacttcaacatctccgctgatgagcctataactgtgacacctcctgactcacaatcatatatctccgtcaattactctgtgagaatcaatgaaacatatttcaccaatgtcactgtgctaaatggttctgtcttcctcagtgtgatggagaaagcccagaaaatgaatgatactatatttggtttcacaatggaggagcgctcatgggggccctatatcacctgtattcagggcctatgtgccaacaataatgacagaacctactgggaacttctgagtggaggcgaaccactgagccaaggagctggtagttacgttgtccgcaatggagaaaacttggaggttcgctggagcaaatactaataagcccaaactttcctcagctgcataaaatccatttgcagtggagttccatgtttattgtccttatgccttcttcttcatttatcccagtacgagcaggagagttaataacctccccttctctctctacatgttcaataaaagttgttgaaagattaacaactatacaaaaaga

SEQ ID NO: 191997 - DNA, 2535 bp, Homo sapiens
  Payload ID: 17935
  Gene Name: transcobalamin II
  Uniprot ID: P20062
  ENST ID: ENST00000215838
  CDS Start-End: 495-1778
actccttgtcctgggctaggtgggcactaccaggggctcctttggtaaggagtaccgggtaggcacccggtcctgccaatccaccactggaacagctggggggacagcagacaggcacggtcggacagacttgacagatcaggcatcaggccctctgcgctggtcccgggctctttaagcaggaacgtgaatggcctcaagatgtctcacatggtcccactagccctcctcctccctttgttccctacctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgctacagtggcctggtgcctcatactcctcaggtgcaggggcagggacaagagaagggggaagtaaccccatcagggaggagtggagggtgcctgagccgccatgtgggcattgggggagtgatgggaatgccagcagtgatgacattgactactgactgagcacccactactatgactgagcactcactcgctagatactatcttgaactgctctgtga

SEQ ID NO: 191998 - DNA, 1870 bp, Homo sapiens
  Payload ID: 17935
  Gene Name: transcobalamin II
  Uniprot ID: P20062
  ENST ID: ENST00000407817
  CDS Start-End: 129-1331
ggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatggcctgtggacctgc

SEQ ID NO: 191999 - DNA, 1936 bp, Homo sapiens
  Payload ID: 17935
  Gene Name: transcobalamin II
  ENST ID: ENST00000405742
  CDS Start-End: 181-1452
ccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctaggcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagg

SEQ ID NO: 192000 - DNA, 2159 bp, Homo sapiens
  Payload ID: 17935
  Gene Name: transcobalamin II
  ENST ID: ENST00000450638
  CDS Start-End: 426-1634
tacctccaggagggctgctctgcccttccttcctctgttctttggccttatgttccccgccaccacagaccttcccccgccccacccctctgcagacttagccgtgcattgcaggcatggaggattaatcagtgacaggaagctgcgtctctcggagcggtgaccagctgtggtcaggagagcctcagcagggccagccccaggagtctttcccgattcttgctcactgctcacccacctgctgctgccatgaggcaccttggggccttcctcttccttctgggggtcctgggggccctcactgagatgtgtgagatggcaggaaaggcgttattttgagatctgcatggaggaagttcaccaggcagcctcaattcaccagctggaagtttgcgttgtttggaaatttgatgtaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcgtggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctccttgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctccgagctggttgtggcacagtagctggggagacctcagcagggctgctcagtgcctgcctctgacaaaattaaagcattgatg

SEQ ID NO: 192001 - DNA, 2988 bp, Homo sapiens
  Payload ID: 17936
  Gene Name: transcription elongation factor A (SII) N-terminal and central domain containing
  Uniprot ID: Q8N8B7
  ENST ID: ENST00000380600
  CDS Start-End: 88-1143
tgtgaggattgagatgactggagtgtgtgtggcctggagagttgctcaataaatatatgttgccttccactgtgaagagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaactgtaaatcagtgttctcttaacagataaccggagtgataccttttatttgtacaacccttttgtgcttttaaaaatcttatacacactactctctaaaacagaaaaaggaggaaagaaagtcgttagctgaagctgccaccaccatccctaaaagttacagtttggggagagggagtggatgactatttatattgtgccttgtggccatttagtaccttactgtagacagagtgtgggtgagaacagcccagcataaactgggagactgtgggaaatgcattcccaggcctcacaccattgaatccgaatctgcattttgacaggatccccaggtaatcttccaggataggatagtttgagaagtgctactttagcaataggcctgtggctctcagcagtggctgcatattaaaatcatctgggaagctttgaaaacccactggtgctgagaccccaccctagaacaattcagttggaacctatgagatgggacccaggcatcaacatttcttttttcattcctcaagttattttaagatgcagtcagagttgagaactactcagaaataggctctcatttgatcctttttacagctctaagacaagaatgttattccaggcacttcacgaatgaggaaacaggtccacagaggtgtggtgacatgtccaagtgacacaaccataaatagtaccaattctgacagatcccagattttctccctcctgactcactgagactggctcaatatcgacttctgagaaatgtattcctggaggtcggggacaaaatgaagaatgtgtttaaactccaacattgggtgactagatcttcattcttttcccctctcttttctcatttataggtctcccttcaaccacaaaagtcaccctggaactcatcccgcagttagaattttgtttggagccctcttgcttagttgaaggagtttcgtagttgttttttgtttttgtttttgtttttgttttttccccctgtgaacaggtttttcgggggtatgtaaactctaggatgtttagtttctgatgtcaggagtcttcatgttctcaaggacaagtgtccttgagatggacattaatggtcattagtctgtcagaggaagcccatcactttagcctttgaatgtagtaacagacgtttatctaataaatgaattgaagataaaattacctctttgaggcctttgcaaacagtgtttaaccagtttatataattgtttgactacaacacgccttctatgtgattatggctgattttttttccttaaaaaactcatggaatgttcaccgttttatagttttaaaaagtttactttggcggtctctacaaacctaccatttcactttctcaccagttcttttctcctaactctcttcctttgttggagctctgaaggcctaactgtgtgtacactttacctgcctgacagaattctccaaaacatgcataaaagtaaaatatgttcgtattttcaaataatttggaagagtcggctcaatgccatcaagtgtaaaatctattttgatatacttgctctccgtgtcttcccagggctgctttttgtgatgcaacatgtttagtccttaacttgcaaggtcatctaaaacttgaagtttcacaaagtgtggtttcatatgacttggaataatctgaaaaactattcagtggttacgaaagagcacagcacataaaaaccaaatttgattagttcaagtcggtgtttatgttttgctttgggggtttgtgtgtatgtgtgtagtttttatttatattggaatttggcaaactaaatgttcagacaaataaaagtaattaaaatggaaa

SEQ ID NO: 192002 - DNA, 2607 bp, Homo sapiens
  Payload ID: 17936
  Gene Name: transcription elongation factor A (SII) N-terminal and central domain containing
  ENST ID: ENST00000467590
  CDS Start-End: 1-818
ataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctgaaacagcaaatggaagaccctgagacaggagactgcctgatacacgcaagttccagcaagagtccacggcagctaagtcacagtgagcaaggggaacaaggatgagagatgcagtcaaagaggccatcgtgagggctcttgtcggtcggccatggtgccgggagcaaagagatgattaagacaccatcccaggcctcaagccccacgaaacgcaggggaagcgccatgctatgcagccagcaatcgttttaccttttaagagctctgagagagacacccactggaaaggggtgcagaggaccccagaggatcaactaacccagtgtgggagggtcagggaaagcttcatagaggccgtgacccttagggcaaatcttgagaggaagatggccaggcagaggaaatgggaaagtctgttccagcaccatatttgctagattcttggcactttatgtatagcatctcctttaatcttcacaactaccctgctgcacagcattttagaggtgaggaaactaaggctgagagagattaagttacttgcccaagggtacacagagacaaagccaggactaactcataacaaagtgggtaggttttgtttattttgcatgtcagattgcttctagaaataacagcaggcttcctattaattccaggtgaggtcctgctattttataattgtggtttgttctttcaatgccaggagcatgtggtgtatggatccccccttacaccagtactgtgcactcctcctgatgatggagagattgggagggaccacctggctaggattgctggctctcctgacaccttctcgtggcatccatgtggtttatccagttttctgaaaatgatacctgcaatatatcagacagaagctgatccattagctcaggttcgtcaggtccagagggaagatgacatggacgggaaccacagctgacccataatggacattaagggtactggaagagcaagtgtctctccattgggacttttataatgaaaagactcacaagatagttggtttcttaagtgtcggaaggactttcagatgctaaccaaaccgcatcccctacaaaagacaaatatcccccacaaacttagaagataagcaaacttgactgggcgcagtggctcactcttataatcccagcgctttgggaggccgaggtgggcagatcacctgatgtcaggagttcaagaccagcctggccaacatggtgaaactctgtctctactaaaaatacaaaaattaaccagacgtggtggtgcacgcctgtaatcccagctactcgggaggctgaagcgggagaatcgcttgaaccctggaggcggacgttgcagtgagccgagatcgtgccacagcactctggcctgggcaacagagtcagactccatctaaaaaaaaaaaaaaaagaaagaagaaagaaaaaagaaaagaaaaagaagataagcaaactttacagctctcttctgcatttccattatgggtgttgatatggtttggctgtgtccccacgtaaatctcatcttgaattgtagctcccataatccccacatgtcgtggggggtaattgaatcgtgggggtgggtttttcccatgacagtgagtaagtcgtaggaggtctgatggttgtataaagggcagttcccccgcacactctctcttgcctgcccccacataagacatgccttcgctcctcctttgctttctgcgatgattgtgaggcctccccagccaagtggaactgtgagttcattaaatctctttttctttataaatt

SEQ ID NO: 192003 - DNA, 1146 bp, Homo sapiens
  Payload ID: 17936
  Gene Name: transcription elongation factor A (SII) N-terminal and central domain containing
  Uniprot ID: Q8N8B7
  ENST ID: ENST00000544987
  CDS Start-End: 1-1146
atgatctcggctcaccgcaaactctgcctcccgggttcaagcaattctcctgcctcggccttccgagtagctgggactacagctgtaaagatgtctgacaagaaccagatagctgccagagcttctcttattgagcaactgatgtccaaaaggaattttgaggatcttggcaaccaccttactgagctagaaacaatttatgtgactaaggagcatctccaggagacagatgtggtcagagctgtgtacagagtcctcaaaaactgcccctctgtggctttgaaaaagaaagccaagtgtttgctatcaaagtggaaagctgtttataagcagactcactccaaagcgaggaacagccctaaattatttcctgtgaggggtaataaagaagaaaattcaggaccttctcatgacccaagtcagaatgagacactgggcatctgcagctcgaattctctgtcttcccaagacgttgcaaaactcagtgaaatgattgtgcctgaaaatagagccattcaattgaaacctaaggaagagcattttggggatggtgaccctgaatccactggcaagagatcgagtgagttgctggatcccacaacacccatgagaactaaatgcatagagcttctttacgcagctttaactagttcttccacagatcaacccaaagctgatttgtggcaaaactttgcaagagaaattgaagagcatgtttttaccctttattcaaagaacatcaaaaaatataaaacttgcatcagaagcaaagttgccaatttgaagaaccccagaaattctcatttacaacaaaacttgctctctgggaccacgtctccacgagaatttgctgaaatgactgtcatggagatggcaaataaggaactgaagcagttgagagcctcctacacggaatcttgtatccaggaacattaccttccccaagtaattgatggcacacagacaaataaaataaaatgcagacgctgtgagaaatacaattgcaaagtcactgtaattgacagaggaacacttttccttcccagctgggtgcggaattcaaacccagatgaacaaatgatgacttacgtaatttgtaacgaatgtggggagcagtggtaccatagcaagtgggtgtgctggtaa

SEQ ID NO: 192004 - DNA, 10436 bp, Homo sapiens
  Payload ID: 17937
  Gene Name: transcription elongation factor A (SII) N-terminal and central domain containing 2
  Uniprot ID: Q96MN5
  ENST ID: ENST00000234827
  CDS Start-End: 201-827
gtggcccagaggcgcgagggccggcggagtttcttcagaggaactaccgccctgggaggaagcgtctgtttagtttcaacacagacgactgggcttgggagcctacgaggttgcagtctggagggcgccaacagcagctaccagggctgcttttcctgaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatattgaacgggaaacgtttcatctctgctcccgcctcattaatgggccgtaccggcggacggtgagagccctggtcttcacattaaagcaccgagctgaaatccgggctcaggtgaagagcggctcgctgccagtcggcacgtttgtacagacccacaaaaagtgacctgaggacggttccagccctgggccaggcagagaggaaaatgggcctgtctctgccgttcaaagacgcttttgagtttgggtgatggctgatgctggctgtgctagattttcccatggtgccgttcctttgcagacagaggattcggagagccctaggagacaggcctgcaggaatgtgcttcattagctgcagtgcgctggtgctgcctaacagaacgcacactggctgtcactaggaagcgccatacggttgctatcacccaacatggtgaaagggtgatggatttcactgtgaatatgccaaggacacctctaaacttcccccatgtcagtcagatgaagttactactatatttcaccaccctgcaggtaactgaaactcaattaccgctgccgctcactcggttccatccccctgagtttagatagctctggtgcctctcagaactcccctgtctgttctctttgctctatcccaggggtgagcctgcgagagccagccaactaccccttcttcccagagctcacttatctgaacgtttcagctctccctggaagaccttctgcgttggtctccagagcccccatgctgaggctactaatgaggaactggcccgaagcctcccacacctcagggtttatttgaatacgctggcgctctcagtttagggctctgtagaagatacataatgaaatttctcttgaaatgaattactgcagtagaaaaaagtacatacatatatatgttaaaatgaaatatctctacacaggcctgttttaacaattacgtaaataatacttgtttttttaaaagtaatagtaagctgggaacttttttttctaaaacaaaaggtggagttcgttcactgaaaagtgttttgagttgagaaggggtacagttggtgaaatttaaaaatgatggaacaaggatttgaggaatgtagaagactcaaggaagtggggattagattaggggagactggagcacgtttgtaatctgaaaggaaagagctggtagaaggggagagatttaaaatccaaaaaaaaggaagatgagttgaaaagcaaggggagaagggacgggactaacattattgcctaccttctaaatactaggcacttttcctaagacagtttattaacctttacctggatctttatatagttttgtaaaaatattgcttacttctctcacccattgtattaagtaggtattgttgttttcattttttagatttattcgtttatttagcaaccatttcctgagcatccattctgtggggtaggtgtatactgagcagtagttacaaatgggagcctgaggctcactgaacagaaacatcaccttcaatttcctactgctagtaactattggagctagaataataataatcgagcgtttaccctgggcccagcactgtggtaaccattttacaaaaagaaaatacccagttaaacatgagaaaagtgaggctcagaaaggtatagtaacttactcaaggtcacgcagatagtgaatgacagatctaagattcaaaatccgggtctatttgattgtatatggttgccttggatgatttcatctactctcatgttttcaagcatcatttacatgctgatgacattccagtttgtatcgtcagcccagacctgtcccctgactttcagatgatatttcctagatgccccatagacatctcagatataacatgtcttctttccattggcagtaccagcaagccagacactccagctaggaactcaaggagtcagcctagaccccacatctcccaccctcagccaaccaagtcctggtggtttgattaggttggtgcaaaagtaattgtggtttttgccattacttctaatatattacttctttgcatttgctgttccagttgcaatgctctttccccagacatctgcatgttcttgtcctcacttgctttaggtctctctttcccttatcaaaaaggcttttgctgactatcctaaatacaatagcactccctcccaactattctttaatgctgtacctagctttatttttcttcagaatatttattactctttaacatagttatttctttattgtctatctccccactcccagaatgtaagcttcatgaaagcagagtctctgttctgttccctgttatatctccagcatctggaacagagcctgggacaagctaggtctccataactatttattggatagttgagtgactggttgtggatgtacagtataagcatctaattcaatcagggagtgcttcctggaggagctgatacctgtgttcagtcttaaagggcaggagtttggataggggaatgttagttaatagaatgaaaatttcaaaattaaagggcaggagtaattaattgggtggttgagatgcatgcctggcagagcaagcagagtatggaaaaacccagaagtggagatatctggaaggtgattggtatggctggagtagaggacactggcaggagagtagctggagatgaggcaggagaggaaggcaaggaccaggatcaggtttgaagggtcttgagcatcaggtgaaggcgttagactgatttgaagcaggaactggtcacttttgtgttaataggctatgtggaagagaagctggggtagggagacaggaagtagcaagcttcatgtttaaagaaccaaagagttctgctaacttaggaacccagagtaagttgaaaacaaattgctctctggctgaaagccttcagtggtgatagttggaaagtagaatgattgcagagatgtgctttggagatttggaaagcaggctgtgttatttgtggctgttttctccttgatgcatgtgcagaatttccatgaacgctaatggagctattctgagcatttgctgaagggaaggaagcttgcagacatccctcccaatcttgcccacacactgagaagtaactcggagctacagtctgttaaaaatgaaaaggttgaggccgggtgcattggttcatgcctataatcccagcgctttgggaggtcgaggcaggcagatcacctgaggtcaggagtttgaaaccagcctggccaacatggcgaaaccctgtctgtactaaaaatacaaaaattagccagatatgatggcaggcgcctgtaatcccagctacttggaaggctgaggtatgagaatcgcttgaacctgggagatggaggctgcagtaagccaagattgtaccactgcactccagcctgggcaacagagtgagactctgtctcaaaaaaaaaaaaaaaaagagaaaaagaaaaaagttgcccctgaaatggggtgagagtagttcctgagacctctgagttacctgtaagtcaaggtgtgaatatgtcttataagcaagttcagttgctaggggaaatgtgggaaagtaaataccatttgtgtctgctctaatagcttattgatgcttttcttgtagtggttaatttggaggtcctggttgggcatggtagctcacacctataatcccagcactttgggaggctgaggcaggcggatcacttgaggtcaggagtttgagaccaacctggccaacatggtgaaaccttgcctgtactaaaaatacaaaaattagccagatctggtggcaggcacctgtaatcccagcactcgataagctgaggcaggagaattgcttgaacccgggaggcggaggttgcagtgagctgagatggcgccattgcactccagcctgggcgacagagcaagactcacctcagtctcaaagataaaataaaataaaaataaataaataaaaattggaggtcttggtcctctgtgtagggactcagtctctgtattttcattcattcattcaacaaacaaatattgcccatcttctgtgtgccaaggactagactggcactggggacacagcaataaaggagagataatttcctctgagtctggtgaggcagatagacacataactaaataaatagagtatagcatattgggtgataactatagacatgaaaatattgagaagatggggaaaggaatgaataacaccactcagaggaagaatcttcacagaggagttcatgtttgaaccaaagccagaaggataggtaggagttcttagcagagggctcagtctatgtgaaagcacagaagcgtgaggtgtatggctagtttcagtaaaggcaaataatatgaggtggctgaagcataaggttcttaggaatggtagtgagaaattgggcaaaaaaagtaaccaaggccttggaggccttatcaacgagtttggactttggccttcagataatgggataccatgggaagtttttgaggaggtgagggacctaatcagatgtgtgttttaaaaagatttaaaaaacaaaaacaaaaacagatattttaagaaaattttaaacattcaaaagaaacccaacaatttaaggcaaaggaaagaaacacttgagattcagtcaattagaggttttttttttttgacaaatgaagtttaaagttgcccaaacagatatcattagagaatcccaggtttgaaaaatggcaggagacccagataatgcatttactgtgttctgtggtgaaggaacaggtagctggcctttttcatttatagaatatcaggttcttaaacttgtgcctgtcaaccttggttttcttttgctgtagcctcaggcctcagaaccttactctgagattggtaatgtgttttgaatgtgtttatcacagccagatggggcaaaggctcagtttgttactgcccattattgcaagggaagggagtccatccagaaaacaaagctttgggagtttcagttagttgggtgacactaccctggtatcaaaggaaagatggtttgattggatgacattgtattttctttaaatcaatcaaaatgatacaattactgtcagggatggacttactcataacctggggaggttggtttcaagatccaagaagatcaagacatccaatcaaatgctggtttttaatgttgataaaatcattctttcaatacatatttgttgagttcttacgtgtcaggtattagggtcacagggatagagaagacataatctttggcctcaagaagcttacagtctagtgaagactgtaaacagacaataaacagacaatttttactatttatttttattttgggagggggtcagggtctcactctgtcgcccagggtgcagtacagtggtgcaattacagctcactgcagctttgacctcccaggttcaagcaagcctcctacctcaagcctcccaagtgtctgggaccataggtatgtgccatcatacctggctgattttttattagccagattgtcaccatgttgatcaggcttgtcttggactcctggcctcaagtgagcctcctgccttggccttccaaagtgttgggattacaggcatgagtcactttgccttgcccagaccatttttgaaaacacaaatgggcagggtgcagtgagatttttaggggccaatggtctgggatgtggcagggacattctcttgaaagtaaaagacaattattgcatctcactccaaccattaagaaggaagcacaatgcctgggagccctctttaggttttggagacagcatatcccacacctaggaatatgctccatccatgtaccggatgacacagaaagttgtgttttgattggggcccagagcaggaaagggctcagcagaagctccaggctacaacacaagtggccatgcggtgtgggacagatgagctggcagagcccaaagtacccgaggtatctgtggtgggaacagatgcctgtgaagtttatgacaagaccctacaggagaatcacaatgtagacacctggggttctggagcagggccatgccatctgtagccaagaattttatacttcttaagaaacaactcttgatgctacagggttctggtagagacagatcatcagaccatggatcatcaagttgaccatgtgaccaaagctgttcatcatgagctggattctgccatatccaccaagtcataaggtcaggcaaagccagcagcaattcctaagatagaaataatacaactggggttgggcatagcagggccagagggcagaagatagttacgtgagcaggtggcccagacatctatgtcatccactacctttgcaccagtacctgcctgttcctcatttcacacctttggctgcctggggagctctttataatatccagctgatagaagagaaaaaaagccatgccttatccttagataggtcagctcagtgtgtgtgagcaagacaaaaaaagaccgtggctgcactgcagccccacacaggggcatccttgaaagacagcagagtggggagtccttctagtgggcataggttgtgcatcatgcacctagccatccactgtatgtggaaagagaaggagcctgagcttagactatacatggatctcatgggcagtggtgaatggcttggctggttggtaaggggtctgaaaggaataagattggaaaattggaaacaaggagacctgtggtggaggcatgtagttggacctataggagtgggcaccaagtgtgaagatcattgtattccatgtaaacacccaccagagagcacataccatggagaagcactaaacaacaatgtacacacagttgacatcaaccagtctctgaggccaccccagagctgacacaatgggtgtataaacagcaaccatggtggtgtagtagtccattttcacactgctataaagatactacctgagactgggtaatttaagaaggaaagaggtttcattgactcaaatttctacatggctggggaggcctcaggaaacttacaatcatggcagaaggcaaggggaagcaggcatcttcttcacaagacagcaggggagagagagagtgcaaagggggaactgccaaacactttgaaaccatcggatctcttgagaagtcactcactatcatgacaacagcatgggggaaaccggctccgtgatccaatcacttcccaccatgtccctccctcaacacgtggggattataattcgagttaagatttgtgtggagacacagagccaaaccatatcagatggtatggcatggctcccactcaccaagactgatctagctattgctgctgctgagtgttcggcctgccagtaacagagaccaactctgaacctagatatagctccatcccttgagaacaaccagcagccacttgggaagttggctatattaaaccctgtctaccctggaaagagctgtgattcattttcactggcatagatgtatattccagatacgagttcatcttcactgcttgtagagcttcatccagcacaactctcaaagggcttatagaatgtttaatctactgggatagattatgggatctatagattatgggatagtcatacaggatcccatatgattccacagcaaaggaggtgcagcagtgggcacatggtgacagggtccacttgtcctttcatctactgcgctatcctgaagctgccagcttgcaactgtgtcgaaggcacagctggggcaccagctcagaaaccctgagagaagagctgccatcctccagggtgcagcacatgttcgaaatcaaagaccgttacgtgatgctttgtctccaataggtagaatacatgagtccaggaaccaagaaatgaaagcaggagtgctctcactcttaccatcacttctagtgacccacttggagtgcctcctgttctcatagttctgggctctgcaggtttagaggttttgagtcacaaaggaggaacacttccactaaaagaaacatcaagattactatgaactattagctgtgactgcacccgggcacttgagctcctcatatcaggagactactaggcaagaacagtcaccattctttgagggataattaatcctgatcatcaggaggaggtacagctgctgttaagcaatggagggaagggaggtatatctttggtactcagttgattcacgtggagacttcttggtattcctttgcccaatttttttttctttttctttttcagaggtggagtctctgtcacccaggctggagtgcagtggcaccatctcggctcactgcaacctctgcctcctgggttcaagctattctcctgcctcagcctcccgagtaactgggattacaggcatgtgccaccatgcccagctgatttttgtatttttagtagagatggagtttcgccatgttggccagactagttttgaacttctggcctcaagcagtccacctgcctcagcttcccaaagtgctgggattacaggcgtgagccactgcgcctggccccttgcccaatatttataaaataattatacaagtgcccagaccgtgacctgagcaggatatgctgacttcaggctcagccccctcagggctgagggtctaaatcatgcctccgtggaagtgacggagaccggaacacgtgctggctgagggtaaggaggatctagaatggatagtagaagagggagatgatgagtatcagttgtggcctcaagaccagtcagtgatggaggttgtagtttgtccaacttactttcctaagtttcccccaggaaaggaggtccaccagaacttaaaccaaaaagtagagctgagcagcacaaatgtgggctgtagtggacaccatcctgtgctgcccagaccccccagccaccatgcttcctgggcctcttcccacagctactgggagtgctctcagccagcagccttcagctgtcagccccctgggaattttcctcaatggaagagttacctcactgacatacccctttcccaggcaggtcagttcaaggttatgaaggcctggccccactgcctcaacttgacaacttggaagggccatctcagcttcaagaccctcccatgagactggctgaggtcttcatacagcatcggagcccaatttatctctctgagcaatcctgcttcctttcctgcccccttcccaagagcaatccctgataaacttcccgcatgctaatctccatctcagagtctactttccaaggaagtgggcctataacatagctcttccagtttttgttaacaattctagaacaggggtcagcaaactttttttttttttcgagacggagtctcactccgtcaccaggctggagtgcagtggcgcgatcttggctcactgcaacctctgcctcccgggttcaagcgattctcctgcctcagcctcccgagtagctgggactaccatgccaccacacccagctaatttttttatttttagagagattgggtttcaccatgttggccaggatggtcttgatctcttgacctcgtgatccgcgctcctcggcctcccaaagtgctgggattatagacatgaatcaccacacccggccagcaaacttttttaaaggaacagatagtaaatattttaagctttgtgagccacatggtctctgtcacaactattcagctctgctattgtaatacaaaagcagctgtggacagtatgtaaatgaatgaatgtggctgtgttccaataaaactttatttacaaaaa

SEQ ID NO: 192005 - DNA, 936 bp, Homo sapiens
  Payload ID: 17937
  Gene Name: transcription elongation factor A (SII) N-terminal and central domain containing 2
  ENST ID: ENST00000371331
  CDS Start-End: 200-916
tcctcgctagagcgtgcacttctggaagctaggaacctcctaactcaggacgtagactgatgattgattacagtttcaattcttcggaagatctttcttttaaagagaaaatcttacttcctgtcaattccactcgaggccccataattcatgaattcttccagagaactcaattgtgttactttggggaaaaaatatcatggcagtctttagtggggttttagaatctgccctctttcttgaccagaacacgctgcaagcacgtcaaggtagtcggagtcccctaacaatggataaattcgtcattcgaacgcctagaatccagaatagccctcagaagaaagattctggaggaaaggtttacaagcaggccacgattgaatctctgaagagagttgtggttgtagaagacataaaaagatggaaaactatgctggagcttcctgatcaaaccaaagagaatcttgttgaagccttacaagaattaaagaagaaaataccctccagggaagtgttaaaatcaacaaggataggtcacactgtgaacaagatgcgtaaacactcagattcagaagtggcttctcttgccagagaagtttacactgagtggaaaactttcactgaaaaacattcaaatagaccttctattgaagttagaagtgatcccaaaaccgagtcgttgaggaaaaatgctcagaaattactctcagaagccttggaattaaagatggatcacctactggttgaaaatattgaacgggaaacgtttcatctctgctcccgcctcattaatgggccgtaccggcggacggtgagagccctggtcttcacattaaagcaccgagctgaaatccgggctcaggtgaagagcggctcgctgccagtcggcacgtttgtacagacccacaaaaagtgacctgaggacggttccagccc

SEQ ID NO: 192006 - DNA, 1783 bp, Homo sapiens
  Payload ID: 17937
  Gene Name: transcription elongation factor A (SII) N-terminal and central domain containing 2
  ENST ID: ENST00000391366
  CDS Start-End: 174-566
aggaggaacacttccactaaaagaaacatcaagattactatgaactattagctgtgactgcacccgggcacttgagctcctcatatcaggagactactaggcaagaacagtcaccattctttgagggataattaatcctgatcatcaggaggaggtacagctgctgttaagcaatggagggaagggaggtatatctttggtactcagttgattcacgtggagacttcttggtattcctttgcccaatttttttttctttttctttttcagaggtggagtctctgtcacccaggctggagtgcagtggcaccatctcggctcactgcaacctctgcctcctgggttcaagctattctcctgcctcagcctcccgagtaactgggattacaggcatgtgccaccatgcccagctgatttttgtatttttagtagagatggagtttcgccatgttggccagactagttttgaacttctggcctcaagcagtccacctgcctcagcttcccaaagtgctgggattacaggcgtgagccactgcgcctggccccttgcccaatatttataaaataattatacaagtgcccagaccgtgacctgagcaggatatgctgacttcaggctcagccccctcagggctgagggtctaaatcatgcctccgtggaagtgacggagaccggaacacgtgctggctgagggtaaggaggatctagaatggatagtagaagagggagatgatgagtatcagttgtggcctcaagaccagtcagtgatggaggttgtagtttgtccaacttactttcctaagtttcccccaggaaaggaggtccaccagaacttaaaccaaaaagtagagctgagcagcacaaatgtgggctgtagtggacaccatcctgtgctgcccagaccccccagccaccatgcttcctgggcctcttcccacagctactgggagtgctctcagccagcagccttcagctgtcagccccctgggaattttcctcaatggaagagttacctcactgacatacccctttcccaggcaggtcagttcaaggttatgaaggcctggccccactgcctcaacttgacaacttggaagggccatctcagcttcaagaccctcccatgagactggctgaggtcttcatacagcatcggagcccaatttatctctctgagcaatcctgcttcctttcctgcccccttcccaagagcaatccctgataaacttcccgcatgctaatctccatctcagagtctactttccaaggaagtgggcctataacatagctcttccagtttttgttaacaattctagaacaggggtcagcaaactttttttttttttcgagacggagtctcactccgtcaccaggctggagtgcagtggcgcgatcttggctcactgcaacctctgcctcccgggttcaagcgattctcctgcctcagcctcccgagtagctgggactaccatgccaccacacccagctaatttttttatttttagagagattgggtttcaccatgttggccaggatggtcttgatctcttgacctcgtgatccgcgctcctcggcctcccaaagtgctgggattatagacatgaatcaccacacccggccagcaaacttttttaaaggaacagatagtaaatattttaagctttgtgagccacatggtctctgtcacaactattcagctctgctattgtaatacaaaagcagctgtggacagtatgtaaatgaatgaatgtggctgtgttccaataaaactttatttac

SEQ ID NO: 192007 - DNA, 2718 bp, Homo sapiens
  Payload ID: 17938
  Gene Name: transcription elongation factor A (SII), 1
  Uniprot ID: P23193
  ENST ID: ENST00000396401
  CDS Start-End: 324-1166
agccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcgtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacatatatc

SEQ ID NO: 192008 - DNA, 635 bp, Homo sapiens
  Payload ID: 17938
  Gene Name: transcription elongation factor A (SII), 1
  ENST ID: ENST00000520534
  CDS Start-End: 24-359
cgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaaggtacttcacagtatagacatatatttatattgaaagtcatagttttacttcctgcatcaattcccctgtctaatgttcccctatttacactcctttttttgttttctaatcaaatggaagtagtaaatgtatgtagccatgtattctaatttatttttttttcagatttcttgaacatttgagaggtagaagacattgaataaataagaagttatttatattgtactcaacaagtttaattgaatgggattgctggggtaggcactgatggaattgataatggaggtagtga

SEQ ID NO: 192009 - DNA, 2858 bp, Homo sapiens
  Payload ID: 17938
  Gene Name: transcription elongation factor A (SII), 1
  Uniprot ID: P23193
  ENST ID: ENST00000521604
  CDS Start-End: 405-1310
agggggccgaaaacccgccccgtgagggggcgggaccggaggtgaacgcgcagcaaaaccgggcgccttccacgaccctctagccggaagccacgcctgcccactagcccgacgcccgcctggcgggaacatgggctcgcccctcaccagcgatctgcagtcagttggtagcgcctgcacgtcgcgcgcggtgttcgattgtcgctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaagtacttccagcggcaatgtaagcaacagaaaggatgagacaaatgctcgagatacttatgtttcatcctttcctcgggcaccaagcacttctgattctgtgcggttgaagtgtagggagatgcttgctgcagctcttcgaacaggggatgactacattgcaattggagctgatgaggaagaattaggatctcaaattgaagaagctatatatcaagaaataaggaatacagacatgaaatacaaaaatagagtacgaagtaggatatcaaatcttaaagatgcaaaaaatccaaatttaaggaaaaatgtcctctgtgggaatattcctcctgacttatttgctagaatgacagcagaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggattgtataattcattaaagctgtggtctttccatgtggagactgatagaaaataattttgtcccaagtcttatttgctgactttttctgtcatgagtgagattgttgaacaaactgaatatatgggctatagcaagtagctttacagtacagatcttacaattaagttttgcttttgttaaagtgtgtaccattttttctgtttggagtaagacaaaaattgttttgacataggttccctagggtacacttgctctagcatactttaaaggccactgttgcaaagtctacattttatgctgaatctgcattctgtcaggcacccgtagaaagacctcagtacatgctttgcactctcctttgctccctttttccaatttcttattgcatatcattttgttgtaatacagaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacata

SEQ ID NO: 192010 - DNA, 569 bp, Homo sapiens
  Payload ID: 17938
  Gene Name: transcription elongation factor A (SII), 1
  ENST ID: ENST00000518310
  CDS Start-End: 190-333
ggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtgtgcagctgacccctaaggctgcttaatgcactctccacctttccaagtccacaagaatcggaatgtcagttaatgctattcgcaagcagagtacagatgaggaagttacatctttggcaaagtctctcatcaaatcctggaaaaaattattagatgggccatcaactgagaaagaccttgacgaaaagaagaaagaacctgcaattacatcgcagaacagccctgaggcaagagaagaaaggtacttcacag

SEQ ID NO: 192011 - DNA, 586 bp, Homo sapiens
  Payload ID: 17938
  Gene Name: transcription elongation factor A (SII), 1
  ENST ID: ENST00000518784
  CDS Start-End: 35-307
agcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtccacaagaatcggaatgtcagttaatgctattcgcaagcagagtacagatgaggaagttacatctttggcaaagtctctcatcaaatcctggaaaaaattattaggtatcattgatcttcccttacatatatttatgatgttgtgatttattcaaatagttaatggttacattttatggttagttaatggttacatttttttcttagtgaatctagatatactgaaagcagtgcctcgtaataaaggcgaggggagttaatttgatctttagggtttttttgccttttaggccagtcaaatttggctttcttaacttttgacacaactggataaactctttcagtaagaagaattttctcttaaaggaaaggttgtggataccttttgaaatggtttttgaaattttttgacttacagaaaactt

SEQ ID NO: 192012 - DNA, 1432 bp, Homo sapiens
  Payload ID: 17938
  Gene Name: transcription elongation factor A (SII), 1
  ENST ID: ENST00000522635
  CDS Start-End: 145-498
gttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcaggaaatggctagtgatgagctgaaagagatgcggaaaaacttgaccaaagaagccatcagagagcatcagatggccaagactggtgggacccagactgacttgttcacatgtggcaaatgtaaaaagaagaattgcacttacacacaggtacaaacccgtagtgctgatgaaccaatgacaacatttgttgtctgtaatgaatgtggaaatcgatggaagttctgttgagttggaagaattggcaaaatatctggaccattaagaaaacggattttgtaactagctttaaactaggccaagcaactagttttcctgcaaatcaaatttttaaagcaacttgggttagactttgtttttgacctaacatcccttccttaaatgccttctgtagtttcagatcagtagggagaccatataataattttatggtacctgtttcaaaacatattttttctgtttttataagtaagttgatattaattaaactcttggcaatatttcttctttcttaaaggaaaatataccttaactttttttcttttacactgtgaaacatacacagtagaaattctgttactctctgttattaatacataaatgaaaatacatttttttccatattggcatgtagctacaaatattaaaggaggagaaaaggtaatataattttaggtttaccaaatatggtgtgtattcaaataatacttgaccagcttatctaaaatgtacataattttgaggtagcttatgaatttgattttaattattatgttcacaagcttggaatattagatattattttgcatctgtaactaaccgtgatcatcatttcttgtaatttcttgtacatgtatattacttgttcttaatagatttttggaaacaagactttattgagatcagtttggttttcctgttaatttacctgtttgactttataatgtgttttagttttgcagaagaacactgttgtagtttagaaggcttttcataaatcccctcataggcaaagatgaaaacttcccactatttttttcccctcttaggaagacatactggaaagaaaatgtttagcatcttagtgtagtatagctattgtaaacagttcatgactagattttgattcggaaatctatactgaccaaggattaatcttaaggat

SEQ ID NO: 192013 - DNA, 563 bp, Homo sapiens
  Payload ID: 17938
  Gene Name: transcription elongation factor A (SII), 1
  ENST ID: ENST00000519704
  CDS Start-End: 202-339
gctgcctggggaggaggagccggagccgccgccgccgccgccgccgccgcgggcttcgttcgtaaggaagggggcctaggcccgggcctgcggtggtgggggttgctgcgcgccgggggtcgctcctgctgtgtcttccgctccagcttcgcccacttccccttgccagcggggtgggcgcggagaagacctgccggagccatggaggacgaagtggtccgctttgccaagaagatggacaagatggtgcagaagaagaacgcggctggagcattggatttgctaaaggagcttaagaatattcctatgaccctggaattactgcagtggctaccttgagatcatcttggcaaaaactcatgagtgatcacaaaggagacttttcttctggagcacaccaaatctgcttgtttcctgtgatgttaacagtgtctcttgatctcagtactcattcctttctgcttttccatcagtgtgcagctgacccctaaggctgcttaatgcactctccacctttccaagtccacaagaatcggaatgtcagttaatgctattcgcaagca

SEQ ID NO: 192014 - DNA, 953 bp, Homo sapiens
  Payload ID: 17939
  Gene Name: transcription elongation factor A (SII), 2
  ENST ID: ENST00000339217
  CDS Start-End: 216-953
gcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcgcgtttgtcaccctccgtctcccatagcatttgtcgccggcaacagtttggagtctgaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacag

SEQ ID NO: 192015 - DNA, 1235 bp, Homo sapiens
  Payload ID: 17939
  Gene Name: transcription elongation factor A (SII), 2
  Uniprot ID: Q15560
  ENST ID: ENST00000343484
  CDS Start-End: 170-1069
aggatgccgcgcgcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgcc

SEQ ID NO: 192016 - DNA, 1427 bp, Homo sapiens
  Payload ID: 17939
  Gene Name: transcription elongation factor A (SII), 2
  Uniprot ID: Q15560
  ENST ID: ENST00000361317
  CDS Start-End: 443-1261
agggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggcgaggccccacaggagaatcgatggttctgatgctgtcagcctctgggtgcaaattctgagggcccgggagcgtctggcggccctgagcagcttgctggggaagctccgtggaggaggaagtccggaggcatgtgatgtgaatcagctgacatcatcttgacgggagccctgtgaggcggacacttaactccagtttcacaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgcc

SEQ ID NO: 192017 - DNA, 1733 bp, Homo sapiens
  Payload ID: 17939
  Gene Name: transcription elongation factor A (SII), 2
  ENST ID: ENST00000395053
  CDS Start-End: 156-884
ggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggctggagggctgctccctcggagcggtgggctaagccactggccccgtgctccaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgcc

SEQ ID NO: 192018 - DNA, 726 bp, Homo sapiens
  Payload ID: 17939
  Gene Name: transcription elongation factor A (SII), 2
  ENST ID: ENST00000415602
  CDS Start-End: 479-726
ggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccag

SEQ ID NO: 192019 - DNA, 1083 bp, Homo sapiens
  Payload ID: 17939
  Gene Name: transcription elongation factor A (SII), 2
  ENST ID: ENST00000440819
  CDS Start-End: 346-1083
gaaccaggtttctctaataaattctctcccttctttagccaggacttagcccgcagcaacttgggttgtgggtagttatgtggacaccctccgaaaagagccggtgtgcttatataagagccaggaggtcgggcaagcctcctctgggagtgtctgggcgctggagcctctggccggctctgttcactgcggcctgggcctctgttgtcttgcggccacagcgagactttggaggaggctgtgtgtgaggactttgaaggggccagtaggcagaaggaggtgatattgtctgttgagatctaaagtcctttatgaaggtcctccttctccttccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacag

SEQ ID NO: 192020 - DNA, 941 bp, Homo sapiens
  Payload ID: 17939
  Gene Name: transcription elongation factor A (SII), 2
  ENST ID: ENST00000458442
  CDS Start-End: 132-941
cacggatgtgggttacaacttggaatgcttgaggctgcagaacccctccccttcttgactgagcagtaagggttccctgctgtggtgcaggaacatgtgggcagagccctgggtgtctccaggagggagccatggatttgctgcgggagctgaaggccatgcctatcacgctgcacctgctccagtccacccgagtcgggatgtctgtcaacgcccttcggaagcagagctcggatgaggaggtcattgcactggccaagtctctcatcaagtcctggaagaagctcctggatgcttccgatgccaaagccagggagcgggggaggggcatgcctctgcccacgtcctcgagggatgcctcagaggccccggatcccagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccatgaccacgtggccatcggtgcggactgcgagcgcctgtcggctcagatcgaggaatgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgcagacccgcagctctgatgagcccatgaccacctttgttgtctgcaacgagtgtggaaaccgctggaag

SEQ ID NO: 192021 - DNA, 1197 bp, Homo sapiens
  Payload ID: 17940
  Gene Name: transcription elongation factor A (SII), 3
  Uniprot ID: O75764
  ENST ID: ENST00000374601
  CDS Start-End: 75-539
ccttcgcgcctcctgcccccgaggccctactgctgcccctgtgcccctcgccccgccgggcgtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaacgagaagaccccaaaaccaggagagactctgtggactccaagtcttctgcctcctcctctccaaaaagaccatcggtggaaagagcatgctcgctgatgcagtaactgaaatgccctcgaggtggcgcacagaagcagcgggcccggcctccagatgcctctactcagacctggggcaggaggattttctaaggactggtgcggtgcgggcacatccggggagcagaaggaagctgttgataaatccaacctcccaccccggccgatgatgccctctctgcagtttggctcagttcccaggcgtgtgcattgaaagcaaaatgagtgtggctgcctgaaatgctgcccagacacgaattccagccagccagccagctcctaaccggggaggcgggaccagggctgggtgtgccctgccaggaaggtgggaagaaatgctccaaacagcctagtcttgctcaggtaggaggactctggaaacctctcttttaaagacacagttgatgtgttgaaaagaatttggaagggcgacaggcaggttcgtggtctgactataccctttgctagttggatggataacttggggcagtaacttggatggataattcagttcagctctctgagcttcagtctactgatctgtaaaatggagacaattatgaacccctttcaaggtcattgtgaggattaaatgaggtaatgaaatacccagcactgttcccaaaccatgtaaatgctcaataaatacataatactttgtaat

SEQ ID NO: 192022 - DNA, 1559 bp, Homo sapiens
  Payload ID: 17940
  Gene Name: transcription elongation factor A (SII), 3
  Uniprot ID: O75764
  ENST ID: ENST00000450454
  CDS Start-End: 108-1154
tgtttggggcccgcgcgggttgcgcgccctccgccttcgcgcctcctgcccccgaggccctactgctgcccctgtgcccctcgccccgccgggcgtcgcgggccaacatgggccaggaagaggagctgctgaggatcgccaaaaagctggagaagatggtggccaggaagaacacggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaacgagaagaccccaaaaccaggagagactctgtggactccaagtcttctgcctcctcctctccaaaaagaccatcggtggaaagatcaaacagcagcaaatcaaaagcggagagccccaaaacacctagcagccccttgacccccacgtttgcctcttccatgtgtctcctggccccctgctatctcacaggggactctgtccgggacaagtgtgtggagatgctgtcagcagccctgaaggcggacgatgattacaaggactatggagtcaactgtgacaagatggcatcagaaatcgaagatcatatctaccaagagctcaagagcacggacatgaagtaccggaaccgcgtgcgcagccgcataagcaacctcaaggaccccaggaaccccggcctgcggcggaacgtgctcagtggggccatctccgcagggcttatagccaagatgacggcagaggaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagttctgctgatggaacagccagccatgaacaaggtgaggaagaagaaagaggaagcgctgaattatctgaactggagaagcaataaaaattaaagtgaaggaaaatactgaactctgtctgagtgggatggtatgagttagaggaagaattctcttgcaaattaataatcggtcattagaaacaattggttaatgggggagcctaattggagaatgatgctgagaatttgtattgatgaacctcttttagaaactgcagagggctgggcacggtggtttatggctgtaatctgcaaactctgggaggctgaggtgggagaatcgcttaaccccagaagtttgagtccagcccaggcaacacagcaagaccccatctctataaaaagaaaaaataaagaaactgcagcgccttaga

SEQ ID NO: 192023 - DNA, 855 bp, Homo sapiens
  Payload ID: 17940
  Gene Name: transcription elongation factor A (SII), 3
  ENST ID: ENST00000476978
  CDS Start-End: 1-237
gaaatggccagtgatgaactgagggagttgaggaatgccatgacccaggaggccatccgtgagcaccagatggccaagactggcggcaccaccactgacctcttccagtgcagcaaatgcaagaagaagaactgcacctataaccaggtgcagacacgcagtgctgatgagcccatgactacctttgtcttatgcaatgaatgtggcaatcgctggaagatggaatcggcttcctgagatccacagaggagaggaaaaacattctgcacttggaccacgcctctttggaaagtgcttccacagatggtatttcctttgaacctggccacagccaaggatgggaaacaggaaggctgagccctgtcagaaaggagttgaacctaaatgccaccaggccatccttccctcctaaggaagctctgaaagtcttacccaagtctgtaactcagactgccccagctcctgcaaaggcagaagttttgttttcacgcatgggagccaaacaaagactcctcccagagtgctccttcctgccaagtctcctgaaggaacagagtgtggtcacgtgcctattgtcagtttccaactgctctctgacttgcatgtgcaccatgtgatgtctgggccaccaggcaggctgcaggtgctccaaaagttctaaggtacttagcaagaagtacaagataagtcaggatccctggtttcaggtcccattctgccctactcatgctgagcatgttactcacctcattgagcaaaagagtaataataatgcctttctcccaggtttgatgatgtgaggatcattttgatatgagggttatcatgtatgcataaacactttgcaaacaacta

SEQ ID NO: 192024 - DNA, 713 bp, Homo sapiens
  Payload ID: 17940
  Gene Name: transcription elongation factor A (SII), 3
  ENST ID: ENST00000461794
  CDS Start-End: 290-643
gcagaaccaaaggctggaggtcaggagcctggctcagagggtttgaacccagcaggtggcgggggatgaagttagagcaccacctaggacagattgtttctcgtctctctccttccttctgccccttgcctgtccttcggccacatgtctgtctgtatcctcctgctctctgtaccaagaccacacaatagtcagagaagcctggtcaggacccaggccccagtcctcaccttgtggcctcccacaggaaggggccctggaccttctgaagaagctgcacagctgccagatgtccatccagctactacagacaaccaggattggagttgctgttaatggggtccgcaagcactgctcagacaaggaggtggtgtccttggccaaagtccttatcaaaaactggaagcggctgctagactcccctggacccccaaaaggagaaaaaggagaggaaagagaaaaggcaaagaagaaggaaaaagggcttgagtgttcagactggaagccagaagcaggcctttctccaccaaggaaaaaacgagaagaccccaaaaccaggagagactctgtggactccaagtcttctgcctcctcctctccaaaaagaccatcggtggaaagagcatgctcgctgatgcagtaactgaaatgccctcgaggtggcgcacagaagcagcgggcccggcctccagatgcctctactcagacctggg

SEQ ID NO: 192025 - DNA, 1197 bp, Homo sapiens; identical to SEQ ID NO: 192021
  Payload ID: 17940
  Gene Name: Transcription elongation factor A (SII), 3
  ENST ID: ENST00000634832
  CDS Start-End: 75-539

SEQ ID NO: 192026 - DNA, 855 bp, Homo sapiens; identical to SEQ ID NO: 192023
  Payload ID: 17940
  Gene Name: Transcription elongation factor A (SII), 3
  ENST ID: ENST00000635497
  CDS Start-End: 1-237

SEQ ID NO: 192027 - DNA, 713 bp, Homo sapiens; identical to SEQ ID NO: 192024
  Payload ID: 17940
  Gene Name: Transcription elongation factor A (SII), 3
  ENST ID: ENST00000635356
  CDS Start-End: 290-643

SEQ ID NO: 192028 - DNA, 1559 bp, Homo sapiens; identical to SEQ ID NO: 192022
  Payload ID: 17940
  Gene Name: Transcription elongation factor A (SII), 3
  ENST ID: ENST00000635035
  CDS Start-End: 108-1154

SEQ ID NO: 192029 - DNA, 1164 bp, Homo sapiens
  Payload ID: 17941
  Gene Name: transcription elongation factor A (SII)-like 1
  Uniprot ID: Q15170
  ENST ID: ENST00000372624
  CDS Start-End: 128-607
ctttggtcgagagggaaagcagaagaagtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactttaaaaaaa

SEQ ID NO: 192030 - DNA, 1201 bp, Homo sapiens
  Payload ID: 17941
  Gene Name: transcription elongation factor A (SII)-like 1
  Uniprot ID: Q15170
  ENST ID: ENST00000372625
  CDS Start-End: 165-644
gcctgtccaccatctccctattaccctttggtcgagagggaaagcagaagaagtctgctggtcacagcggggcacctcgaggagaggacgactaggagcacacggcccggaaaggtccaggtcagggaagggaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactttaaaaaaa

SEQ ID NO: 192031 - DNA, 721 bp, Homo sapiens
  Payload ID: 17941
  Gene Name: transcription elongation factor A (SII)-like 1
  Uniprot ID: Q15170
  ENST ID: ENST00000372626
  CDS Start-End: 191-670
aggggaagtagcacagaggaagaggcaatactacccgagactagatgcggaccgtctctggcaaccaggaaaaggcaaatacaaagagaggtctgctggtcacagcggggcacctcgaggagaggacgactaggagcacacggcccggaaaggtccagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgcca

SEQ ID NO: 192032 - DNA, 1080 bp, Homo sapiens
  Payload ID: 17942
  Gene Name: transcription elongation factor A (SII)-like 2
  Uniprot ID: Q9H3H9
  ENST ID: ENST00000329035
  CDS Start-End: 200-883
gcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 192033 - DNA, 1100 bp, Homo sapiens
  Payload ID: 17942
  Gene Name: transcription elongation factor A (SII)-like 2
  Uniprot ID: Q9H3H9
  ENST ID: ENST00000372780
  CDS Start-End: 220-903
agcggtcgggtccgggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctctgagaggcctgaaaaggaagagcaacctgtccagaatccccgcaggaaaggaaaaggaggggaaatctcgacatggaaaaactcttcaatgaaaatgaaggaatgccttcgaatcaaggaaagatagacaatgaagaacagccaccgcacgagggaaagccagaagtagcttgtattctggaagacaagaagttagaaaacgagggaaacacagaaaacacgggcaagagagttgaggaaccgttaaaggataaagaaaagccagagagtgcgggaaaggcaaaaggagaaggaaagtcagagaggaagggaaagtcagagatgcagggaggatcaaagacagagggaaagccagagagagggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaggaagccatacatgatatgaatttcagcaatgaggacatgataagagaatttgacaacatggctagggtggaggataaaaggagaaaaagcaaacagaaattgggggcgtttttgtggatgcaaagaaatttacaggaccccttctatcctaggggtccaagggaattcaggggtggctgcagggccccacgaagggacactgaagacattccttatgtgtagtgtccctggcaggcatttgtcaggccatatgttttaaccttatggtaatactttgctttagtcgttcctcctgctaccagtagcgttttgacccacctgccagtgtttgcttgctctatgtttcagtagcagattttcacacatgtgcattgcagagacgtcatgattcgtggaaaaataaagcagcttataatatc

SEQ ID NO: 192034 - DNA, 1124 bp, Homo sapiens
  Payload ID: 17943
  Gene Name: transcription elongation factor A (SII)-like 3
  Uniprot ID: Q969E4
  ENST ID: ENST00000243286
  CDS Start-End: 263-865
gtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtcagtgtgaaggtctgcgcgtctgttcccagcgctctgcgaggcctaaaaaggaggagcaacctgtccagaatccctgcaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgc

SEQ ID NO: 192035 - DNA, 1113 bp, Homo sapiens
  Payload ID: 17943
  Gene Name: transcription elongation factor A (SII)-like 3
  Uniprot ID: Q969E4
  ENST ID: ENST00000372627
  CDS Start-End: 251-853
gtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtctgcgcgtctgttcccagcgctctgcgaggcctaaaaaggaggagcaacctgtccagaatccctgcaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgca

SEQ ID NO: 192036 - DNA, 1221 bp, Homo sapiens
  Payload ID: 17943
  Gene Name: transcription elongation factor A (SII)-like 3
  Uniprot ID: Q969E4
  ENST ID: ENST00000372628
  CDS Start-End: 359-961
gggagacagaacttgaggactgaggagagaggaggcccaggacagaaccctaggaacactgccactcaaggtggcagctcagcttcctggcaggcagcaccaccctgggctctggagtcaggcagagacagtcttgaaagcgggctctggagttctggggctgagcgctcttggcaaagtcgggtaccctctttgatcagctgtcacacctggcgataatggcatcagagagagataccctgcgaggatgccgtgagatgcgccaggtctgcgcgtctgttcccagcgctctgcgaggcctaaaaaggaggagcaacctgtccagaatccctgcaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgca

SEQ ID NO: 192037 - DNA, 1511 bp, Homo sapiens
  Payload ID: 17944
  Gene Name: transcription elongation factor A (SII)-like 4
  Uniprot ID: Q96EI5
  ENST ID: ENST00000372629
  CDS Start-End: 240-1316
ttggtctaagacatgggctgacaaactttttccataaagggccagaaagtaaatatttcaggctttgtgggatatctatttatgatttattttactcctagtattatttcatcttttatacaggttattaaggttagtattgctgcataacaaattactccaaaatttaatcatttatattcaagaagagttcagctgctaggttcttattttgggactctcatgatgctgaggtcaagatgccagctggaggccaggcgccgcagctcacgcctgtaatcccagcgttttgggaggccaggggcctcccaaattcaaaaggaagagacaaagtccacatctgtcaatgcgaagaatggaaaggtcacatatcatatgtggagcgggacataacaacttcggaaattaaatctcttccccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtctgcgcgtctgttgttcccagcgctctgcgaagcctgaaaaggaggagcaacctgtccagaatccccgcaggtccgtgaaagacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaa

SEQ ID NO: 192038 - DNA, 338 bp, Homo sapiens
  Payload ID: 17944
  Gene Name: transcription elongation factor A (SII)-like 4
  ENST ID: ENST00000425011
  CDS Start-End: 165-338
cttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatg

SEQ ID NO: 192039 - DNA, 891 bp, Homo sapiens
  Payload ID: 17944
  Gene Name: transcription elongation factor A (SII)-like 4
  ENST ID: ENST00000434216
  CDS Start-End: 742-891
tctgctccggttcctgggctcctaattcttggtccagcttcttccaggtcagtgtgcgggccttccacgctgccagcggaacactggaatggcggaaggggaacgggtacggcagggggaaaggctgggggtggggtcgggtcgagtcgagggaagctggcccgagtgtggacagagatggcggtgggaaaacggctaggggtggctgagggggagcacgtaggcagtgggcagagggtgaggaaggcgagcacccccaagtatccatgctcgctttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaag

SEQ ID NO: 192040 - DNA, 959 bp, Homo sapiens
  Payload ID: 17944
  Gene Name: transcription elongation factor A (SII)-like 4
  Uniprot ID: Q96EI5
  ENST ID: ENST00000415568
  CDS Start-End: 133-780
gcacgggcgcagatgtaggcaccggtccgagtgcctgccctctgtccccgcggctgggtctcgtctgctccggttcctgggctcctaattcttggtccagcttcttccaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacac

SEQ ID NO: 192041 - DNA, 1273 bp, Homo sapiens
  Payload ID: 17944
  Gene Name: transcription elongation factor A (SII)-like 4
  Uniprot ID: Q96EI5
  ENST ID: ENST00000472484
  CDS Start-End: 213-860
ctgcacgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattggaaaacagtgaa

SEQ ID NO: 192042 - DNA, 1135 bp, Homo sapiens
  Payload ID: 17944
  Gene Name: transcription elongation factor A (SII)-like 4
  Uniprot ID: Q96EI5
  ENST ID: ENST00000468024
  CDS Start-End: 293-940
gggctgcggcattcacgtgatctgcacgggcgcagatgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacgggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaa

SEQ ID NO: 192043 - DNA, 779 bp, Homo sapiens
  Payload ID: 17944
  Gene Name: transcription elongation factor A (SII)-like 4
  ENST ID: ENST00000459722
  CDS Start-End: 506-779
tgtaggcaccggtccgagtgcctgccctctgtccccgcggctgggtctcgtctgctccggttcctgggctcctaattcttggtccagcttcttccaggtcagtgtgcgggccttccacgctgccagcggaacactggaatggcggaaggggaacggagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagg

SEQ ID NO: 192044 - DNA, 1571 bp, Homo sapiens
  Payload ID: 17944
  Gene Name: transcription elongation factor A (SII)-like 4
  Uniprot ID: Q96EI5
  ENST ID: ENST00000472745
  CDS Start-End: 553-1200
gcaccggtccgagtgcctgccctctgtccccgcggctgggtctcgtctgctccggttcctgggctcctaattcttggtccagcttcttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtaggggaggaaaacgttggatgagaagggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttcttta

SEQ ID NO: 192045 - DNA, 681 bp, Homo sapiens
  Payload ID: 17944
  Gene Name: transcription elongation factor A (SII)-like 4
  ENST ID: ENST00000490644
  CDS Start-End: 452-681
gcagatgtaggcaccggtccgagtgcctgccctctgtccccgcggctgggtctcgtctgctccggttcctgggctcctaattcttggtccagcttcttccaggcacatcctcttctctgccctccgtccattttggagccggagatggtgggctggggccgccccagtagtgagacagtggaagtaaaccccatctgccgttcccgtgcgtagagaaaaacgttgaccgcgaggctggggaggagagttgcctctgaggaagaagggcacagagacccaaaattagtttggaaagcatcctgatttggtgcccgaggcctggaaagaaatggcggctggggtgcggcggaggtctgcgcgtctgttgttcccagcgctctgcgaagcctgaaaaggaggagcaacctgtccagaatccccgcaggacaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcaga

SEQ ID NO: 192046 - DNA, 566 bp, Homo sapiens
  Payload ID: 17944
  Gene Name: transcription elongation factor A (SII)-like 4
  ENST ID: ENST00000469586
  CDS Start-End: 179-566
ggcctggactcaggaaagggaaccgcgtccgtgtgagcccgctgagcgcgcagaccctgcccctgtctcctgtctgtctgcaggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaa

SEQ ID NO: 192047 - DNA, 1008 bp, Homo sapiens
  Payload ID: 17944
  Gene Name: transcription elongation factor A (SII)-like 4
  Uniprot ID: Q96EI5
  ENST ID: ENST00000494801
  CDS Start-End: 158-805
cgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaagccagagagtgagggagaggcaaaagaaggaaagtcagagagggagggagagtcagagatggagggaggatcagagagagagggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggc

SEQ ID NO: 192048 - DNA, 1166 bp, Homo sapiens
  Payload ID: 17944
  Gene Name: transcription elongation factor A (SII)-like 4
  ENST ID: ENST00000613326
  CDS Start-End: 204-764
acgggcgcagatgtaggcaccggtccgagtgcctgccctctgtccccgcggctgggtctcgtctgctccggttcctgggctcctaattcttggtccagcttcttccaggtctgcgcgtctgttgttcccagcgctctgcgaagcctgaaaaggaggagcaacctgtccagaatccccgcaggaaaaggaggggaaatctcgacatggaaaaactctacagtgaaaatgaaggaatggcttcaaaccaaggaaagatggaaaatgaagaacagccacaagacgagagaaagccagaagtaacttgtactctggaagacaagaagttagaaaacgagggaaagacagaaaacaagggcaaaacaggagatgaggaaatgttaaaggataaaggaaaaccagagatagagggaaagccagagagtgaaggagagccagggagtgaaacaagggctgcaggaaagcgcccagctgaggatgatgtacccaggaaagccaaaagaaaaactaataaggggctggctcattacctcaaggagtataaagaggccatacatgatatgaatttcagcaatgaggacatgataagagaatttgacaatatggctaaggtgcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctttaacgttacggtaatactttactttaggcatccctcctgttgctagcagccttttgacctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgattttttctgttcttttttgttcatctgtccatttttctcctaaaaacagatttctttagtcataaaaataataaaatataaagtattgg

SEQ ID NO: 192049 - DNA, 1168 bp, Homo sapiens
  Payload ID: 17945
  Gene Name: transcription elongation factor A (SII)-like 5
  Uniprot ID: Q5H9L2
  ENST ID: ENST00000372680
  CDS Start-End: 296-916
agtgggctggctcctgacgcactttctgcgggtgggaggggaactagggacccgagcccactggtgacgtttttctcacgtgatctgaagccgacgtgtgcagaagtccctctcctccaggtaccagatccctgtttccgtggaggaaggcagacttcagactgaaggacagagaaggcaactgccctacagccctgcaggtcttcaagtctgtggttgtgggcactaacccagacaagaaaaggaaagacctgcagtatcggtgcaggaaaggcaaagaagggaacatctcaacatggaaaagctctacaaagaaaatgaaggaaagccagagaatgaaagaaacctagaaagtgagggaaagccagaggatgagggaagtacagaagatgaaggaaagtcagacgaggaagaaaagccggacatggaggggaagacagaatgcgagggaaagcgagaggatgagggagagccaggtgatgagggacaactggaagatgagggaaaccaggaaaagcagggcaagtctgaaggtgaggacaagccacaaagtgagggcaagccagcctcccaggccaagccagagagccagccgcgggccgccgaaaagcgcccggctgaagattatgtgccccggaaagcaaaaagaaaaaccgacagggggacggacgattcccccaaggactctcaggaggacttacaagaaaggcatctgagcagtgaggagatgatgagagaatgtggagatgtgtcaagggctcaggaggagctaaggaaaaaacagaaaatgggtggttttcattggatgcaaagagatgtacaggatccattcgccccaaggggccaacggggtgtgaggggagtgaggggcggaggtaggggccagaaagacttagaagatgtcccatatgtttaatgtctttggcctttaattctgatttctctgatgggaatattgccagtcctgcttttcctggcaggcatttgccggcctatgtgctttaaccttaagctgatactttcctttaggtgtcactcttgttaccagcagacttttgacccaactacagtgctctgtcttttagtagaggattttcacccatgtgcatggaataaatgttcatggtacattgtaaaataacaataaaaaagagttttcagaaccatg

SEQ ID NO: 192050 - DNA, 983 bp, Homo sapiens
  Payload ID: 17946
  Gene Name: transcription elongation factor A (SII)-like 6
  Uniprot ID: Q6IPX3
  ENST ID: ENST00000372773
  CDS Start-End: 362-913
gggagagacaacttgaggactgaggagagaggaggcccaggacagaaccccaggaacaccgccactcaaggtggcagctcagcttcctggcaggcaccactaccccccgggctctggagtcaggcagagccggtattgaaagtgggctgtggagttctggggctaagcgctcttggcaaagtcgggtaccctctctgatcagctgtcacacctggcgataatgggcatcagagagagatgccttgcgaggatgctgtgagctgcgtcaggtctgcgcgtctgttgttcccagcgctcttggaggcctgcaaaggaagagcaacctgtccagactccccgcaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattct

SEQ ID NO: 192051 - DNA, 1106 bp, Homo sapiens
  Payload ID: 17946
  Gene Name: transcription elongation factor A (SII)-like 6
  Uniprot ID: Q6IPX3
  ENST ID: ENST00000372774
  CDS Start-End: 251-802
gtgggcaccagcccccgcgcccgcccgcccgcccagcggtccggtccaggcgcccgcgcagaatcagctgtctgagctgcccaggcggcgggggagcagcgagcgggcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaaggggacaacggggtgtcaggggagtgaggggtggaggtaggggccaaagaggcttacacgatatcccatacctttaatgcctttggccttccattctgacttctctgatgagattattgtcaaccctgctttccctggtagatatttgccaggcccaatgctttaaccttaagctgatatttttgctttagatgtcaatctcgttaccagcagccttttgacccaactacagcgctctatattttagtagaggattttcacccatgtgcatggaaaagatgttcatgacacattgtaaaaaataaataaataaagaacagtttgcagaacc

SEQ ID NO: 192052 - DNA, 992 bp, Homo sapiens
  Payload ID: 17946
  Gene Name: transcription elongation factor A (SII)-like 6
  ENST ID: ENST00000622517
  CDS Start-End: 145-744
gcttcagcgagccgcaggaggcacaggcctgtcctgggtccccgcaggtctgcgcgtctgttgttcccagcgctcttggaggcctgcaaaggaagagcaacctgtccagactccccgcaggacaggaaaaagagaaatctcgacatggaaaaaccctacaataaaaatgaaggaaacctggaaaacgagggaaagccagaagatgaagtagagcctgatgatgaaggaaagtcagacgaggaagaaaagccagacgcggaggggaagacagaatgcgagggaaagcgaaaggctgagggagagccaggtgatgagggacaactggaagataagggaagccaggaaaagcagggcaagtccgaaggtgagggcaagccacaaggcgagggcaagccagcctcccaggcaaagccagagggccagccgcgggccgccgaaaagcgcccggctggagattatgtgccccggaaagcaaaaagaaaaacagacagggggacggacgattcccccaaggactctcaggaggacttacaggaaaggcatctgagcagtgaggagatgatgagagaatgtggagatgtgtcaagggctcaggaggagctaaggaaaaaacagaaaatgggtggttttcattggatgcaaagagatgtacaggatccattcgcccaagggcaacggggtgtcaggggagtgaggggtggaggtaggggccaaagaggcttacacgatatcccatacctttaatgcctttggccttccattctgacttctctgatgagattattgtcaaccctgctttccctggtagatatttgccaggcccaatgctttaaccttaagctgatatttttgctttagatgtcaatctcgttaccagcagccttttgacccaactacagcgctctatattttagtagaggattttcacccatgtgcatggaaaagatgttcatgacacattgtaaaaaataaataaataaagaacagtttgc

SEQ ID NO: 192053 - DNA, 1177 bp, Homo sapiens
  Payload ID: 17947
  Gene Name: transcription elongation factor A (SII)-like 7
  Uniprot ID: Q9BRU2
  ENST ID: ENST00000332431
  CDS Start-End: 255-557
gtgaaccgaagtccttatattcccgggcttctttctcctctgggtaccagctccttactgccctgcagacaagcgtgccgtgcgtgcttgtggccaagggaaggaagagctggttgatccacagatagctccttcctccccgccccttcctttttgtttggaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttttctttttgcctatctgcatcttctcacttgccaaaaaatgaatatatgtttatgtgtgtatattacttgtgtcacaaaaaaccctaaagtagacagtaaaagaacttgtcaatcgcctttggaaggcaatgaaacacttaataaactctcaataacagaagcgtaaaaatgaaatgtaaacctccaattacctctggatctcttagccagagtaataaactggtaattattacagata

SEQ ID NO: 192054 - DNA, 852 bp, Homo sapiens
  Payload ID: 17947
  Gene Name: transcription elongation factor A (SII)-like 7
  Uniprot ID: Q9BRU2
  ENST ID: ENST00000372666
  CDS Start-End: 168-470
tctcctctgggtaccagctccttactgccctgcagacaagcgtgccgtgcgtgcttgtggccaagggaaggaagaggtcccaggatctgtgttcacagacatctgggggaagaaaaggagcaggaaactaccccgcacagagttaagcaggaaacaacaacaacatcatgcaaaaaccctgcaaagaaaacgaaggaaagccaaagtgcagcgtgccaaagagggaggaaaaacgcccgtatggagaatttgaacgccagcaaacagaagggaattttagacagaggctgcttcagtctctcgaagaatttaaagaggacatagactataggcattttaaagatgaagaaatgacaagggagggagatgagatggaaaggtgtttggaagagataaggggtctgagaaagaaatttagggctctgcattctaaccataggcattctcgggaccgtccttatcccatttaattaatttctctgacaattcaattattttctgttattaatgttgccactgctttctgtttgtctgcactttcttgataaatatttgctatcgttttactccagtcattcgatgttgctgagatttacatatgactcttgtcaacatctcatcttttgacccaatcttattcatttaataagaggtctcattcatttgcatggaaaaatgctcattgtatattgcaaagtgaaaataacgagttgcaaaacagtgtatacatatatgtgtgtatatatgtacactttatttgtacatttctatgtgacataatgcaaaggaaagtgtctgattttattatacaccaaaggttaacagtgaatctctgtgtgatctctttttttt

SEQ ID NO: 192055 - DNA, 1131 bp, Homo sapiens
  Payload ID: 17948
  Gene Name: transcription elongation factor A (SII)-like 8
  Uniprot ID: Q8IYN2
  ENST ID: ENST00000360000
  CDS Start-End: 147-500
acgtgaccaggagtcgacgtgtgcagaagtccttatagtccagggcctgtttccctgtagcagctccttattgctggagaaggagaaaagtgcccaagatcctttcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 192056 - DNA, 1222 bp, Homo sapiens
  Payload ID: 17948
  Gene Name: transcription elongation factor A (SII)-like 8
  Uniprot ID: Q8IYN2
  ENST ID: ENST00000372685
  CDS Start-End: 238-591
agtgatgacgcgactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggcagaaggaaatcctcaaccttccgaagaaggcgtaagccaggaagcagaaggaaaccccagaggagggccgaatcagcctggccagggatttaaagaggacacacccgttaggcatttggaccctgaagaaatgataagaggagtagatgagcttgaaaggcttagggaagagataagaagagtaagaaacaagtttgtgatgatgcattggaagcaaagacattcacgcagccgtccttatcctgtgtgctttaggccttgaattcatttttgcctaatattaaaatctggccccagctttctttctgttagcattttctgatgtatctttgacctccattttacttttaatcatctgatgaaattttgttttaggtaatttccttggtaccagcatctcattggattttggattttgacccattttccaggtctatttttcaattggaaactttcacacatttgcatgggaatatgttcattccatgttgtaaagtaaaacataacaggttatggcaaagcagcatatttaatatcagctcacatatgtaggataaaattccaaactttgtgtgtgtgcgtgtgtgtatacatacatccatataacatatatcacaaacttaaccaagcttatttctgtgtggtgtgaaattttatttgttttcttctttttgttctttttgcttatatgtactttttaatgaacacgtgtctcacacacaaaaagaattaaggattttttttacaagtaagagtcaaataatttgcaaccagcttatgagggcaatgggggcacctaaactcttgatgaaagaactttaaaaagaaatgtaaacctcaaattacctctggatctcttagccagaggaataaactggcaattattacagata

SEQ ID NO: 192057 - DNA, 449 bp, Homo sapiens
  Payload ID: 17948
  Gene Name: transcription elongation factor A (SII)-like 8
  ENST ID: ENST00000451678
  CDS Start-End: 227-449
gactctcacgtgaccaggagtcgacgtgtgcagaagtccttatagtccagggcctgtttccctgtagcagctccttattgctggagaaggagaaaagtgcccaagatcctttcaggatatttggttttttgggcgcgacacaaatcgaggtgagggaagagagaggaaaatcccctgaatccctgcaggattaatttattcaaaaaggaaataaaaaatactcaatatgcaaaagtcttgtgaagaaaatgagggaaaaccacagaacatgccaaaggccgaggaagatcgccctttggaggatgtaccacaggaggacacacccgttaggcatttggaccctgaagaaatgataagaggagtagatgagcttgaaaggcttagggaagagataagaagagtaagaaacaagtttgtgatgatgcattggaagcaaagacattcacgca

SEQ ID NO: 192058 - DNA, 683 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000284811
  CDS Start-End: 116-454
acccggctgcggtggctgcgggactgacgagtgagtctcgggctggggcggaaacggagctccgggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaa

SEQ ID NO: 192059 - DNA, 719 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000523815
  CDS Start-End: 285-623
gggagaagagggcggcgggacctttcctggcgccgctcgcagtttacatgtggatttattcattctggagatacaatggcaaggaaacagctgtgagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgc

SEQ ID NO: 192060 - DNA, 1573 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000520242
  CDS Start-End: 222-560
caggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctac

SEQ ID NO: 192061 - DNA, 1943 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000518127
  CDS Start-End: 94-432
cagacggaagtgagcgacacactctgcgtcctcgcctcaccaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagctcattcagcttttctattaagcagccaaaaaattttttgaaaaaatatgacagcatcattccttatgcatggggaaagaagcactggagatgggtttagtattgtctttatctcagaggtggaacaaagttgtcattatagggtctataaacttaagtctccagcttatttgagactggcttaatatggctgagcccggtggctcatgcctgtaatcccagcactttcagaggacgaggcgggtagatcacttgaggccaggagtttgagaccagcctggccaccatggcaaaaccccatctctaccaaaaatgcaaaaattagctaggccatggtggcacacgcctgtaatcccagctacttgtgaggctgaggcatgagaatcgcttgaacctgggaggtggaggtggcagtgagccgagatcgcaccactgcactccagcctgggtgacagagcgagactgtctcaaaaaaaaaaaaaaaaaaa

SEQ ID NO: 192062 - DNA, 814 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000519487
  CDS Start-End: 110-448
tagcagtttacatgtggatttattcattctggagatacaatggcaaggaaacagctgtggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtg

SEQ ID NO: 192063 - DNA, 634 bp, Homo sapiens
  Payload ID: 17949
  Gene Name: transcription elongation factor B (SIII), polypeptide 1 (15kDa, elongin C)
  ENST ID: ENST00000519082
  CDS Start-End: 366-634
ctcaccaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgaagtcttgctgtgtggcccaggctggagtgcccggctggtctcaaattcctgacctcaagtgatctccctcccaaagtgttgcgattgcaggtgtgagccactgcacctggctgctgagaaatctttgcctacagtgagggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagat

SEQ ID NO: 192064 - DNA, 816 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000522337
  CDS Start-End: 321-659
cgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagatcatcagggaaggaagacctctctgaggagttgatgttttacctggagacctaaatgatgaggatttaaaagcttttcggacaacagcaattacaaatgcaaagaccttgaggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaa

SEQ ID NO: 192065 - DNA, 1451 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000520210
  CDS Start-End: 139-429
accggagcaggcagctgggggtgggggggcggccctgggataggggctgtggcagtacgcggggacccggctgcggtggctgcgggactgacgaatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaa

SEQ ID NO: 192066 - DNA, 2780 bp, Homo sapiens
  Payload ID: 17949
  Gene Name: transcription elongation factor B (SIII), polypeptide 1 (15kDa, elongin C)
  ENST ID: ENST00000602840
  CDS Start-End: 196-393
gactgccccggaacccaccggagcaggcagctgggggtgggggggcggccctgggataggggctgtggcagtacgcggggacccggctgcggtggctgcgggactgacgagtgagtctcgggctggggcggaaacggagctccgggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccagacatggtctccactatgttgcccaggctgaagtgcagtggctgttcataggcacaatcatagcacactgcagccttccactcatggcctcaagcagtcatcctgcctcagcctctcatagctgggactaaaggcacacaaaactgcacccagctggggaaattttaaagttgctttgagatagatctcatggtcttaatcatcaaattattctataaattttgtatttttgtgtgatggtactctcgtataggacagacacaggtacatcagaatttgattttttcctctctgtattagtccattttctgctcataaaggcatacccgagaccgggcaatttacaaaagaaaggtttaatcgacttacagttccatgtggctggggaggcctcacaatcatggtggaaggtgaaaggcacaaagagaagagagcttgtacagagaaattccccatttttaaaaccatcagatctgagacttactcactatcacaaggacagcacaggaaagacctgcccccgtgattcaattacctcctgctgagtccctcccacaacacgtgggaattcaagatttgggtggggacacagccaaaccatatcatgccattcctggcccctcccaaatctcatgtcctcacatttcaaaaccactcatgggccaggtgtggtggctcatgcctgtaatcccagtgctttgggaggctaagctgggaggatcacttgaggtcaggagtttgagaccaacctggccaacatggcaaaaccccgtttttactaaaaataccaaaattagccagatgtggtggcagacatctgtgatcccagccactagggaggctaagacaggagaactgcttgaacccaggaggcggaggttgcagtgaactgagattgtaccactgcactccagcctggtcgacagagaagacactgtctcaaaaaaaaaaacaacgaaaaagaatcatgccttcccaacagtccccctatgtcttaactcatttttcagcattcagaaatccacagtccaaagtctcatctgagacaaggcaagtcccttccacctatgagcctgtaaaatcaagagcaagttagttacttcctagatacaatgggggaatgggcattgggtaaatacagccattccaaatgggagaaattggccaaaacaaaggggctacaggccccatgcaagtcagaaatccagtggggtagtcaaagttccaaaatgatctcctttgactccatgtctcacatccacatcatgttgatgcaagaggtgagttcacgtgggcagctccacacctgtggctttgcagggtacagcctgccttctggctgctttcatgggctggtgttgagtgtctgcaacttttccaggcacacggtgtaagctgtcaagtggatctaccattctggggtctggaggatggccttctcagagctactctaggagtgccccagtagtgactccgtgtgagggctctgaccccacatttttcttttttcttttttttcttttctttcttttttttttttttttgagacagtttcactctccaggttggagtgcagtggtgcaatctcagctcactgcaacctccacttcctgggttcaagcaattctgcctcagcctcccaagtagctgggattacaggcatgtgccaccatgcctggctaatgtttttgtatttttagtagagatgggatttcaccacgttggccaggctggtctcgaactcctgacctcaggtgatccttctcggccttccaaagtgctgggattacaggagggagccaccatgcctgactcttacttcacatttttcttccacactgccctatcagagggtccccatgagagccctgccctgcagcaaacttctgcctggacatccaggcatttcgatatatcttctgaaatctaggcagaggttcccaaacctcaattcttgacatctgtgcactgacaggctcaacaccatttgaaagctgccaaggattgaggcttgcaccctctgaagccacggcccaaactctatgttggcccctttcagccatggctggagtggctaggatgcatggcaccaagtgcctaggcttcacacagcatggggaccctgagcccagtccccaaaaccacttttttgtgacagagtcactctgttgcccaggctggagtgcagtggcacgatctcggctcactgcaatctctgcctcccagattcaaacaattctcctgcctcagcctcctgagtagctgggatgacgggcacatgccgtgctgacatgcctagctaatttttgtattttttgtagagatgggattttgctatgttggccaggctggtttcaaactcctgacctcaagtgatccgcccaccttggcctcccaaagtgctgagattaccggcatgagccactgtgcccaccctg

SEQ ID NO: 192067 - DNA, 1976 bp, Homo sapiens
  Payload ID: 17949
  Gene Name: transcription elongation factor B (SIII), polypeptide 1 (15kDa, elongin C)
  Uniprot ID: Q15369
  ENST ID: ENST00000622804
  CDS Start-End: 146-484
gggagaagagggcggcgggacctttcctggcgccgctcgcagtttacatgtggatttattcattctggagatacaatggcaaggaaacagctgtggaaactactaaagttcctggggaagcaaagtagaatttcataagaacaaaatggatggagaggagaaaacctatggtggctgtgaaggacctgatgccatgtatgtcaaattgatatcatctgatggccatgaatttattgtaaaaagagaacatgcattaacatcaggcacgataaaagccatgttgagtggcccaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagctcattcagcttttctattaagcagccaaaaaattttttgaaaaaatatgacagcatcattccttatgcatggggaaagaagcactggagatgggtttagtattgtctttatctcagaggtggaacaaagttgtcattatagggtctataaacttaagtctccagcttatttgagactggcttaatatggctgagcccggtggctcatgcctgtaatcccagcactttcagaggacgaggcgggtagatcacttgaggccaggagtttgagaccagcctggccaccatggcaaaaccccatctctaccaaaaatgcaaaaattagctaggccatggtggcacacgcctgtaatcccagctacttgtgaggctgaggcatgagaatcgcttgaacctgggaggtggaggtggcagtgagccgagatcgcaccactgcactccagcctgggtgacagagcgagactgtctc

SEQ ID NO: 192068 - DNA, 582 bp, Homo sapiens
  Payload ID: 17950
  Gene Name: transcription elongation factor B (SIII), polypeptide 2 (18kDa, elongin B)
  Uniprot ID: Q15370
  ENST ID: ENST00000262306
  CDS Start-End: 39-524
gctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcacctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccca

SEQ ID NO: 192069 - DNA, 991 bp, Homo sapiens
  Payload ID: 17950
  Gene Name: transcription elongation factor B (SIII), polypeptide 2 (18kDa, elongin B)
  Uniprot ID: Q15370
  ENST ID: ENST00000409906
  CDS Start-End: 59-415
cgggaacggggcggagcgcggctgcgccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgaggacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctgagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccca

SEQ ID NO: 192070 - DNA, 997 bp, Homo sapiens
  Payload ID: 17950
  Gene Name: transcription elongation factor B (SIII), polypeptide 2 (18kDa, elongin B)
  ENST ID: ENST00000409477
  CDS Start-End: 81-422
gcggcggggggcggctgggccgcgcggggggcccgggcttcgtgctcacgccggcccgccgcccccaggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgaggacccccaagaggcccatttcccccaataaaagagatttgggagtctgcctggttgctgcctctttttcccgcccctccctgggatgggtcccactccctgtgggctccttttggggcttgtgcttggcagttcctgtgctgtcctgtctcccagatcctgagaccctggctgagaacttggcccagcctgctgcttaaaggcaccatggggacctgggttgccctgagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaacacaagctggagccagtgtcctggtttgacagcatgttcaacgagggaaccccaagacggacccacacaggtccacccacgctgggggctgtaatcacggagggaagtggctgcccccttaacacacctttaataaacagtctacagaccc

SEQ ID NO: 192071 - DNA, 472 bp, Homo sapiens
  Payload ID: 17950
  Gene Name: transcription elongation factor B (SIII), polypeptide 2 (18kDa, elongin B)
  ENST ID: ENST00000494946
  CDS Start-End: 1-423
gacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagttgctggtcagaagtctttgggacttgccccatgtagggcctctcccaagatcctgcttctctcctcaggatgaccaactcttggatgatggcaagacactgggcgagtgtggcttcaccagtcaaacagcacggccacaggccccagccacagtggggctggccttccgggcagatgacacctttgaggccctgtgcatcgagccgttttccagcccgccagagctgcccgatgtgatgaagccccaggactcgggaagcagtgccaatgaacaagccgtgcagtgaggacccccaagaggcccatttcccccaataaaagagatttgggagtctg

SEQ ID NO: 192072 - DNA, 331 bp, Homo sapiens
  Payload ID: 17950
  Gene Name: transcription elongation factor B (SIII), polypeptide 2 (18kDa, elongin B)
  ENST ID: ENST00000572954
  CDS Start-End: 34-234
gccggcgcgtcgaggggagaggcagcagccgcgatggacgtgttcctcatgatccggcgccacaagaccaccatcttcacggacgccaaggagtccagcacggtgttcgaactgaagcgcatcgtcgagggcatcctcaagcggcctcctgacgagcagcggctgtacaagatgacacctttgaggccctgtgcatcgagccgttttccagcccgccagagctgcccgatgtgatgaagccccaggactcgggaagcagtgccaatgaacaagccgtgcagtgaggacccccaagaggcccatttcccccaataaaagagatttgggagtc

SEQ ID NO: 192073 - DNA, 5154 bp, Homo sapiens
  Payload ID: 17951
  Gene Name: transcription elongation factor B (SIII), polypeptide 3 (110kDa, elongin A)
  Uniprot ID: Q14241
  ENST ID: ENST00000418390
  CDS Start-End: 272-2668
attccgtcttgaagtagaccctggagaggtcttccaggcttgggctcagcacgcgagcacagggagcgggggtgccggcggcggaggcgcgtacggcccgagcagcccccagcccccagcgcgcacacttgggccaggggcgcgaggagtgcgcggccgccgggtgggcgctggggagcgggccctgggggcggagcctgcagcccaccgccccccacacaccccagccgaggcccggaaggggccaggcgcgcttccgtctccgccggggatgcacggagggcggagctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatattatcccccaggtttgtttttgttttttgtcctctaccacacatttagccttttatcttccaggtccttattaaaatcagatgaaagcctagtgaaagccagtctcctgccccagctcagctctgtgtggactctggtccagacagaggactgggcatctccagagcctgcacagtacctgctgcacgtagggcaaggaatgagcactagaccgcctgtccccaagggagcctcagtggggcgacagggtgctcggcggactccacctcaggccctccccactgttgctgtgcattcctgtgcaggtgcatctctttcttactaactggtatttattaagggaggtgctctgtaggtctggagcctttccctcatcctttttgcgagtccccacctttttgtttttttttttttctttgaggctcactagaggacgcagaaccttgggagattgatttgcacagaactccccacctcccacttttacaatttccagtttctgattgaaaattttagggtttctccccactgcccttccctatctttccttcccctcaacaccatgaaggaaaaacacacacggcagggctttttgtagccctgaaggcaactttagacatttaaaatccagcactttaatctcttgttctctgtgaatcactatgagaagtgaatggttttaaaggctgtaatgctatgttggaaattggtttgttttgccttttattgaaaaggtaagatcatgtgattggaagaacacaactgttggcttgggaagaggactttgctgctgaagtgttttctaccttctgagtgtgtttaaggcaggatttggagggaaggaccagcttagggagagtgtctgagccacagcgtcaggatgggggaaaccacatgggatccatcaagttccagttgaacaggagcaagatcagaacttaggagggcagtgtcagctcccttgttggctgtcaaggaacaccgatctagtagaaacccacttggttgtgacccaggtagaggtagatgccatacatttgagatatgcgtccttaaggaacctgacaagcagactgaagggatggtaagtgtgacagcctgataagttttctcaaagcccaggatacagagccagtgttttctgtaactggagacctcagttaggccaacttcgaattccagagcaacgtaggaagtctattcagcagaaactcgacattgttcagtgtgtattgctgtgcagggtgcctattgtgacaggacacaaatgttactatgttttaatttgctatatttttgaatgggtaaagcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctaggtgtctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtctaaataaaaaacaaactcca

SEQ ID NO: 192074 - DNA, 2671 bp, Homo sapiens
  Payload ID: 17951
  Gene Name: transcription elongation factor B (SIII), polypeptide 3 (110kDa, elongin A)
  ENST ID: ENST00000609199
  CDS Start-End: 33-2351
gttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagat

SEQ ID NO: 192075 - DNA, 4924 bp, Homo sapiens
  Payload ID: 17951
  Gene Name: transcription elongation factor B (SIII), polypeptide 3 (110kDa, elongin A)
  Uniprot ID: Q14241
  ENST ID: ENST00000613537
  CDS Start-End: 61-2457
cccccacacaccccagccgaggcccggaaggggccaggcgcgcttccgtctccgccggggatgcacggagggcggagctgcggcccgaggacgcgacgcgagcccagttccggcgaggaggccgcgccagtgacagcgatggcggcggagtcggcgctccaagttgtggagaagctgcaggcgcgcctggccgcgaacccggaccctaagaagctattgaaatatttgaagaaactctccaccctgcctattacagtagacattcttgcggagactggggttgggaaaacagtaaatagcttgcgaaaacacgagcatgttggaagctttgccagggacctagtggcccagtggaagaagctggttcctgtggaacgaaatgctgagcctgatgaacaggactttgagaagagcaattcccgaaagcgccctcgggatgccctgcagaaggaggaggagatggagggggactaccaagaaacctggaaagccacggggagccgatcctatagccctgaccacaggcagaagaaacataggaaactctcggagctcgagagacctcacaaagtgtctcacggtcatgagaggagagatgagagaaagaggtgtcacagaatgtcaccaacttactcttcagaccctgagtcttctgattatggccatgttcaatcccctccatcttgtaccagtcctcatcagatgtacgtcgaccactacagatccctggaggaggaccaggagcccattgtttcacaccagaagcctgggaaaggccacagcaatgcctttcaggacagactcggggccagccaagaacgacacctgggtgaaccccatgggaaaggggttgtgagtcaaaacaaggagcacaaatcttcccacaaggacaaacgccccgtggatgccaagagtgatgagaaggcctctgtggtgagcagagagaaatcacacaaggccctctccaaagaggagaaccgaaggccaccctcaggggacaatgcaagggagaaaccgccctctagtggcgtaaagaaagagaaggacagagagggcagcagcctgaagaagaagtgtttgcctccctcagaggccgcttcagacaaccacctgaaaaagccaaagcacagagacccagagaaagccaaattggacaaaagcaagcaaggtctggacagctttgacacaggaaaaggagcaggagacctgttgcccaaggtaaaagagaagggttctaacaacctaaagactccagaagggaaagtcaaaactaatttggatagaaagtcactgggctccctccctaaagttgaggagacagatatggaggatgaattcgagcagccaaccatgtcttttgaatcctacctcagctatgaccagccccggaagaaaaagaaaaagattgtgaaaacttcagccacggcacttggagataaaggacttaaaaaaaatgactctaaaagcactggtaaaaacttggactcagttcagaaattacccaaggtgaacaaaaccaagtcagagaagccggctggagctgatttagccaagctgagaaaggtgcctgatgtgttgccagtgttgccagacctcccgttacccgcgatacaggccaattaccgtccactgccttccctcgagctgatatcctccttccagccaaagcgaaaagcgttctcttcaccccaggaagaagaagaagctggatttactgggcgcagaatgaattccaagatgcaggtgtattctggttccaagtgtgcctatctccctaaaatgatgaccttgcaccagcaatgcatccgagtacttaaaaacaacatcgattcaatctttgaagtgggaggagtcccatactctgttcttgaacccgttttggagaggtgtacacctgatcagctgtatcgcatagaggaatacaatcatgtattaattgaagaaacagatcaattatggaaagttcattgtcaccgagactttaaggaagaaagacccgaagagtatgagtcgtggcgagagatgtacctgcggcttcaggacgcccgagagcagcggctacgagtactaacaaagaatatccagttcgcacatgccaataagcccaaaggccgacaagcaaagatggcctttgtcaactctgtggccaagccacctcgtgacgtccggaggaggcaggaaaagtttggaacgggaggagcagctgtccctgagaaaatcaagatcaagccagccccgtaccccatgggaagcagccatgcttccgccagtagcatcagctttaaccccagccctgaggagccggcctatgatggcccaagcaccagcagtgcccacttggcaccagtggtcagcagcactgtttcctatgatcctaggaaacccactgtgaagaaaattgccccaatgatggccaagacaattaaagctttcaagaacagattctcccgacgataaactgaggacttgccttggaaatggaatctggggaggcaggaatacaaggacagtgggggttggggaatggaattctacaggagactggagtcttgctttgtggatccttttggtctccgagtcctgcagtctgcaggtgctgcccctgggaacctgcgtgccacagccccgcctccctgcctggagcacactttagaattctgaagatgtgaagcctctgtctcactgaggattttaaaggtcaattatacttttgttgttcattagcatctttgtaaactataagacgtagttttaattaataaatattgcccccagattgtatttatattatcccccaggtttgtttttgttttttgtcctctaccacacatttagccttttatcttccaggtccttattaaaatcagatgaaagcctagtgaaagccagtctcctgccccagctcagctctgtgtggactctggtccagacagaggactgggcatctccagagcctgcacagtacctgctgcacgtagggcaaggaatgagcactagaccgcctgtccccaagggagcctcagtggggcgacagggtgctcggcggactccacctcaggccctccccactgttgctgtgcattcctgtgcaggtgcatctctttcttactaactggtatttattaagggaggtgctctgtaggtctggagcctttccctcatcctttttgcgagtccccacctttttgtttttttttttttctttgaggctcactagaggacgcagaaccttgggagattgatttgcacagaactccccacctcccacttttacaatttccagtttctgattgaaaattttagggtttctccccactgcccttccctatctttccttcccctcaacaccatgaaggaaaaacacacacggcagggctttttgtagccctgaaggcaactttagacatttaaaatccagcactttaatctcttgttctctgtgaatcactatgagaagtgaatggttttaaaggctgtaatgctatgttggaaattggtttgttttgccttttattgaaaaggtaagatcatgtgattggaagaacacaactgttggcttgggaagaggactttgctgctgaagtgttttctaccttctgagtgtgtttaaggcaggatttggagggaaggaccagcttagggagagtgtctgagccacagcgtcaggatgggggaaaccacatgggatccatcaagttccagttgaacaggagcaagatcagaacttaggagggcagtgtcagctcccttgttggctgtcaaggaacaccgatctagtagaaacccacttggttgtgacccaggtagaggtagatgccatacatttgagatatgcgtccttaaggaacctgacaagcagactgaagggatggtaagtgtgacagcctgataagttttctcaaagcccaggatacagagccagtgttttctgtaactggagacctcagttaggccaacttcgaattccagagcaacgtaggaagtctattcagcagaaactcgacattgttcagtgtgtattgctgtgcagggtgcctattgtgacaggacacaaatgttactatgttttaatttgctatatttttgaatgggtaaagcattactttacttctcttggttacttgtaccaccattccacccctatccctagcctgccccacaaatctaatattaggaagcctcttaactgaaaccaaatgaacatttgggtcaggtgccagatgtctgctgcctagaatagctttttctaggtgtctaccaccttgaatttatctcttaactgtgtgttcaagtctttgtcattgaaactagtttttcatatcttagattcagttgtgtatgatttaatgtcccttattaggagtctttaggcagggagggaagaaaaaacagatttgttcatagcaatgtcagtatccattttggcacataaagatttttgatgagccctgtttgcatagagccagatgttttcccctcccccaagagtatctacatcagggatgtgacttggtgcgaagagtcaggggaaagaggaaaaacccaatttctaaatgacctccttgcccagcttactaaaatggctgcagagcagacacaggatgaatttgaacctgacacaggatgaatttgaacctttggtctcatttatggaaaaacttgtgcaattttttttctgtgctacactacatacaaatcaccaaattacaaattacccttttgtgatccttggtgtactgagcagtttctttggggctttttctttctgggaagcgggagggaaaggagcaaggtgtcatcctgctcttcatttgtattttggtcccaaaatgtaaatacaattttctatgttacttttttgtggtaactaccgagatgaatattttaattagataagttatatgaaaaggaaaattccatgtct

SEQ ID NO: 192076 - DNA, 3050 bp, Homo sapiens
  Payload ID: 17952
  Gene Name: transcription elongation factor B polypeptide 3B (elongin A2)
  Uniprot ID: Q8IYF1
  ENST ID: ENST00000332567
  CDS Start-End: 358-2619
aagagggtcagggctagagccgtgagtgtcagcctgggatgggctacataaggcccagctctggcaccagagcttcattctttgttgcacagcaaactgcagaggtcactccaggctgtggctccacatcccgaggaacaaaagcgggcctgctcagctgtctgcaaggacggccgttccagaccaagtggcctgctgctccgaggacccagctcgctccaggctgtgactccacatcccgaggtcgctgcctggcgaccgggcagcgaggaccggccaccccagacttcctgtcccgcagccccaaagacagagctgcgaccgccgggacagcgacgcctgcacagctctggtgagatggcggcagggtccactacgctgcacgcagtggagaagctgcaggtgcgtctggccactaagacggagccgaaaaagctagagaaatatttgcagaaactctccgccttgcccatgacggcagacatcctggcggagactggaatcagaaagacggtgaagcgcctgcggaagcaccagcacgtgggcgactttgccagagacttagcggcccggtggaagaagctggtgctcgtggaccgaaacacccggcctggcccacaggaccctgaggagagcgcttcccgacagcgcttcggggaggctcttcaggaccaggaaaaggcctggggcttcccagaaaacgcgacggcccccaggagcccatctcacagccctgagcacagacggacagcacgcagaacacctccggggcaacagagacctcacccgaggtctcacagtcgcgagcccagagctgagagaaagtgccccagaatagccccagctgattccggccgctatcgggcctctccaacgcgcacagctcccctccggatgcccgagggccctgagcccgctgcgcccgggaagcaacccggaagaggccacactcacgcggctcagggcgggcctctgctgtgtccaggctgccagggccaaccccaggggaaagccgttgtgagccacagcaaggggcacaaatcgtctcgccaggaaaaacgccccttgtgtgcccagggagattggcactcccctactttgatcagggagaaatcatgcggggcctgcttaagagaggaaaccccaaggatgccctcctgggcaagtgccagggacaggcagccttcggacttcaagacagacaaggaaggggggcaagctggcagcggccagcgtgtccctgccttggaggaggctccagacagtcaccagaagaggcctcagcacagtcactcgaacaagaagaggcccagtctagacggccgggacccaggaaatgggacacacggcctgtcgcccgaggagaaagagcagctttccaacgaccgagagactcaagaggggaagccaccgactgctcatttggacagaacgtccgtgagctccctctctgaggtggaggaggtagatatggctgaggaattcgagcagcccactctgtcatgtgaaaaatacctcacctacgatcagttgcggaagcaaaagaaaaagactggaaaatctgccaccactgcacttggagataaacaaaggaaagcaaacgaatccaagggcactcgtgagtcctgggattcggctaagaaattgcctcctgtccaggaaagccagtcagagaggctgcaggcggccggcgctgattccgccgggccgaaaacggtgcccagccatgtcttctcagagctctgggacctctcagaggcctggatgcaggccaactacgatccgctttcggattctgactccatgacctcccaggcaaagccagaagcactctcttcaccaaagttccgggaggaagctgctttccctggacgcagagtgaatgctaagatgccggtgtactcgggctccaggcctgcctgccagctccaggtgccgacgctgcgccagcagtgtgcccaggtgcttagaaacaatccggacgccctcagcgacgtgggagaggtcccctactgggttcttgaacctgttctggaagggtggaggcccgatcagctgtatcgcagaaagaaagacaatcacgcactcgttagagagacagacgaattacggaggaatcattgtttccaggacttcaaggaagaaaagccacaggaaaacaaaacttggagggagcagtacctgcggcttccggacgccccagagcagcggctgagagtaatgacaacgaatatccgatctgcacgtggaaacaaccccaacggcagagaggcaaagatgatctgtttcaaatctgtggccaagacgccttatgatacttcaaggaggcaagagaagtctgcaggagacgctgaccccgaaaatggggagatcaagccagcctccaagcccgcgggaagcagccacactccctccagccagagcagcagcggcggtggcagagacagcagcagcagcatccttcgctggctccctgagaagcgggccaacccctgcctgagcagcagcaatgagcacgcggcgcccgcggccaaaacccggaaacaggctgccaagaaagtggccccgctgatggccaaggcaattcgagactacaagagaagattctcccgacgataaactcaggacttgccttgcagataaaatctggggggatttttgcattggcaaagtcaatgcgggttggggaacgaaacttccaatggacaccagaacctttaacttggtgcaaagttgagcctttgaattctgcaggtgtcatgtgctggccctgtgattttgcctcccacacccagccactacctcccagcttggagaacacctcagaattcagaagatatgaacgcattgggaacaattctattttggatgttcactgataatttttaaaaacaccctagttgtaatcataaataaggaaaaagatgtgagatttcctttttcctttcttttttttttcgaaatcaagtagataagaacttcttagacaaaaacacacaagccattagttgacactgataactccgaatacataaaatgtttgctgttgc

SEQ ID NO: 192077 - DNA, 1641 bp, Homo sapiens
  Payload ID: 17952
  Gene Name: transcription elongation factor B polypeptide 3B (elongin A2)
  ENST ID: ENST00000620522
  CDS Start-End: 1-1641
atggcggcagggtccactacgctgcacgcagtggagaagctgcaggtgcgtctggccactaagacggagccgaaaaagctagagaaatatttgcagaaactctccgccttgcccatgacggcagacatcctggcggagactggaatcagaaagacggtgaagcgcctgcggaagcaccagcacgtgggcgactttgccagagacttagcggcccggtggaagaagctggtgctcgtggaccgaaacacccggcctggcccacaggaccctgaggagagcgcttcccgacagcgcttcggggaggctcttcaggaccaggaaaaggcctggggcttcccagaaaacgcgacggcccccaggagcccatctcacagccctgagcacagacggacagcacgcagaacacctccggggcaacagagacctcacccgaggtctcacagtcgcgagcccagagctgagagaaagtgccccagaatagccccagctgattccggccgctatcgggcctctccaacgcgcacagctcccctccggatgcccgagggccctgagcccgctgcgcccgggaagcaacccggaagaggccacactcacgcggctcagggcgggcctctgctgtgtccaggctgccagggccaaccccaggggaaagccgttgtgagccacagcaaggggcacaaatcgtctcgccaggattcggctaagaaattgcctcctgtccaggaaagccagtcagagaggctgcaggcggccggcgctgattccgccgggccgaaaacggtgcccagccatgtcttctcagagctctgggacctctcagaggcctggatgcaggccaactacgatccgctttcggattctgactccatgacctcccaggcaaagccagaagcactctcttcaccaaagttccgggaggaagctgctttccctggacgcagagtgaatgctaagatgccggtgtactcgggctccaggcctgcctgccagctccaggtgccgacgctgcgccagcagtgtgcccaggtgcttagaaacaatccggacgccctcagcgacgtgggagaggtcccctactgggttcttgaacctgttctggaagggtggaggcccgatcagctgtatcgcagaaagaaagacaatcacgcactcgttagagagacagacgaattacggaggaatcattgtttccaggacttcaaggaagaaaagccacaggaaaacaaaacttggagggagcagtacctgcggcttccggacgccccagagcagcggctgagagtaatgacaacgaatatccgatctgcacgtggaaacaaccccaacggcagagaggcaaagatgatctgtttcaaatctgtggccaagacgccttatgatacttcaaggaggcaagagaagtctgcaggagacgctgaccccgaaaatggggagatcaagccagcctccaagcccgcgggaagcagccacactccctccagccagagcagcagcggcggtggcagagacagcagcagcagcagcagcaatgagcacgcggcgcccgcggccaaaacccggaaacaggctgccaagaaagtggccccgctgatggccaaggcaattcgagactacaagagaagattctcccgacgataa

SEQ ID NO: 192078 - DNA, 1877 bp, Homo sapiens
  Payload ID: 17953
  Gene Name: transcription elongation factor B polypeptide 3C (elongin A3)
  Uniprot ID: Q8NG57
  ENST ID: ENST00000330682
  CDS Start-End: 237-1877
acatcccgaggaacagaagcgggcctgctcagctgtctgcaaggaccggcgttccagaccaagtggcccgctgctccgaggacccagctcgctccaggctgtgactccacatcccgaggtcgccgcctggcgaccgggcagcgaggaccggccaccccagactgcctgtgccgccgccccgagctcggacagagccgcgaccgcgaggacagcgacgcctgcacagctctggcgagatggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccggcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccagcgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggttcttgaacccgttctggaagggtggacgcccgatcagctgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 192079 - DNA, 1641 bp, Homo sapiens
  Payload ID: 17954
  Gene Name: transcription elongation factor B polypeptide 3C-like
  Uniprot ID: Q3SY89
  ENST ID: ENST00000614938
  CDS Start-End: 1-1641
atggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccggcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccaacgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggttcttgaacccgttctggaagggtggacgcccgatcagccgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 192080 - DNA, 1218 bp, Homo sapiens
  Payload ID: 17954
  Gene Name: transcription elongation factor B polypeptide 3C-like
  ENST ID: ENST00000620688
  CDS Start-End: 1-1218
cctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccggcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccaacgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggttcttgaacccgttctggaagggtggacgcccgatcagccgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 192081 - DNA, 1641 bp, Homo sapiens
  Payload ID: 17955
  Gene Name: transcription elongation factor B polypeptide 3C-like 2
  Uniprot ID: A6NLF2
  ENST ID: ENST00000620881
  CDS Start-End: 1-1641
atggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccgtcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccaacgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggctcttgaacccgttctggaagggtggacgcccgatcagccgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 192082 - DNA, 1262 bp, Homo sapiens
  Payload ID: 17956
  Gene Name: transcription elongation factor, mitochondrial
  Uniprot ID: Q96QE5
  ENST ID: ENST00000306049
  CDS Start-End: 38-553
aatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgaga

SEQ ID NO: 192083 - DNA, 1891 bp, Homo sapiens
  Payload ID: 17956
  Gene Name: transcription elongation factor, mitochondrial
  Uniprot ID: Q96QE5
  ENST ID: ENST00000581216
  CDS Start-End: 623-1705
cttctaagaggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattc

SEQ ID NO: 192084 - DNA, 2109 bp, Homo sapiens
  Payload ID: 17956
  Gene Name: transcription elongation factor, mitochondrial
  ENST ID: ENST00000580840
  CDS Start-End: 38-718
aatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagaggtaaggcagttgcacctccagattcctacctgctagagctccttgtgtagtttaatcttctggtcccaaaaggaatgtaataaaatagtaaagatgggttttcttctggtacttgttactcacttattcctattatgttttccatcacctttgatttttaaaaattcaacctttagttagttcaagaaatgccttatgcatcgaaggcagatactgagaaaatcaatggtatttcattctaaatgttatagaacattatcactcttttatttataaagcttatttttcaaaatgccatcacattgtctcatttgagttttcaaaaccttgcgaaatggtcaggaattatcaccttaatggtcaggaattaccaccttgattatacatatgaaatctgtggttcagtcaagcatctgatgtgattagtcagttgcagaggtgattgattcttgctagttattctaaccgtatgctctatcccagaaaatgtttgaaggtttagtaaaacagttttaagttgtctaaccttaaagccaatacatattttagaaattatgaagtccactgtacagatcaagaaactggtacttaggaggactaaacagcttagcttagctgttgttgtgacataaccatgaccagaaccagactgctcataaaatggctttttcagttatttcaaaattgtcaatatagtataaattaactaattataatatttttaaatagaagtgggacagagaggggaccaaacataaaatgtaatgaattatttctgttcctttattttgtctttttttaaaaagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgaga

SEQ ID NO: 192085 - DNA, 4654 bp, Homo sapiens
  Payload ID: 17957
  Gene Name: transcription elongation regulator 1
  Uniprot ID: O14776
  ENST ID: ENST00000296702
  CDS Start-End: 39-3335
acgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtagcaatgatgcaaatagtcagctgcccgtatgtaaagacagtcgctaccaccaagaccggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttatatatctgtattgtatatgattattgttacttaatttttaagagcttattttaacctgtttttaaaagcagcaaatagaatttcccacaaagtaagttgactctaaatcttaagtattacctagtttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttaaaaaaaaatctttttattttatgccttcataggttgctcgtttcagagtgccacataaataaaatgtttaacaaaa

SEQ ID NO: 192086 - DNA, 3633 bp, Homo sapiens
  Payload ID: 17957
  Gene Name: transcription elongation regulator 1
  Uniprot ID: O14776
  ENST ID: ENST00000394421
  CDS Start-End: 19-3252
tgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccg

SEQ ID NO: 192087 - DNA, 3518 bp, Homo sapiens
  Payload ID: 17957
  Gene Name: transcription elongation regulator 1
  ENST ID: ENST00000549332
  CDS Start-End: 5-3103
tgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtagcaatgatgcaaatagtcagctgcccgtatgtaaagacagtcgctaccaccaagaccggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagttaatttagtgaaagatgtgaaagtgaaagcttgtgaaagatgctgggattggcagccccgcagactgaagtcctctgttcatccacagaacagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagc

SEQ ID NO: 192088 - DNA, 2618 bp, Homo sapiens
  Payload ID: 17958
  Gene Name: transcription elongation regulator 1-like
  Uniprot ID: Q5VWI1
  ENST ID: ENST00000368642
  CDS Start-End: 87-1847
gagttcgctccggagccgcgccgccgccggcccagcatctcgggcgcccgccgcccccgccgccgccgtcagcgcggggatgtaggatgcaggcgggcgccaggttccagcggcggcggcggcagctgcagcagcagcagccccggcggcggcagcctctcctctggccgatggacgcagagccgccgccgccgccgccctgggtctggatggtgccgggctcggccgggctgctccggctcagcgcgggggtcgtggttcccccggtgctgctcgcctcggccccgccgcccgcggccccgctgctccccggtctccccggctggccggccccgagcgagccggtgctcccgctgctgccgctgccctctgcgccagactccgccgccgccgccgccgcgcaccccttccccgcgctccacgggcagtggctgtttggtggccattctccgtccctaggactgcccccctcttccacagtggagctggtgcccgtcttcccacatctctgcccttctgctcttgcaacccctattgggaaaagttggatagacaaaaggattcctaactgtaagatcttttttaataattcctttgctctggactcaacgtggatacatcctgaggagtcaaggtttttccatgggcatgaaaagcctcgtttgctggcaaatcaagtagctgtgtctctgtccaggccggctcctgcctccaggccgctccccacggtggtgttagcacctcagcccatcccaggtggctgccataacagccttaaggtgaccagcagccccgccattgccatcgccaccgccgccgccgctgccatggtctccgtggaccctgagaacctccggggcccgtccccctccagcgtgcagccgcgccacttcctgaccttggcacccatcaaaatacccctccggacgtcccccgtctcagatacaaggacagagcggggccgagtggcccgccctcctgccctgatgctgcgggcccagaagagccgggatggagacaaagaagacaaggagcctccaccgatgctggggggaggagaggacagcacagccagaggcaacaggccagtggcctccaccccggtgcccggatccccctggtgtgtggtctggacgggcgatgaccgagttttcttcttcaacccaacgatgcacctgtctgtctgggagaagcccatggacctgaaggaccgcggagacctcaacaggatcattgaggacccgccccacaaacgcaagctggaggcaccagcaactgacaacagcgatgggtccagttctgaagacaacagggaagaccaagatgtgaaaaccaagaggaaccggaccgaaggctgcgggagtcccaagccagaggaggcaaagagagaggacaaaggcacaaggacgccgcccccgcagatcctcctgcctctggaggagcgtgtgacccacttccgagacatgctgctggagagaggggtatcagcattttctacctgggagaaagaattacacaaaatcgtgtttgacccacgctatctcctgctcaactctgaggaacgaaagcagatatttgaacagtttgtcaagacaagaataaaagaagaatacaaggaaaagaaaagtaaattgctgctagccaaagaagaattcaagaaacttctagaggaatctaaagtgtctcccaggaccacgtttaaggagtttgcagagaaatacggccgggatcagaggttccgacttgttcaaaaaagaaaggaccaggagcattttttcaaccaattcatacttattcttaagaaacgggacaaggaaaacagactaaggctgcggaaaatgagatgagtttgtgaaaaaatgcaataagcccgggggttgaccctgggcgtgccgggggcgagggggtcacggtggagacggacacgggcgtggggcggccgagacctgcacggcccagcgggcaccggcactgcggggtcttcgttctcagaggattactgtttcatattgaagctctctcttttgtacattcagagtttgatgcatttctaatcaccgtgatacgtcgatcccttaattgttttaattatgcaaattacttgtaatatacacaaattatcaatccactgcaggactgtggggaagcaggaacgggagcctctgtaacaatctcaaggcatttgtgtcatcacctaagacgattggcgaaaacttttctgaaaacctttgtgaattacttcgtttctccaggattcccgcagtgttgaggaattccttactctgtccctaggtctcagtctcgtttctgagtagcagcaatagggttttcatcattcatcatagtgacaactgtgagcattccacacctggaccgtggatcacttacaggtttccaagggtggccgcgcgttcctcccagaggggcgtcccggcctggagcagggagccgtgttggttgccaccggtcctacttcaaaagaattattttgtacaaaatcatcatattaatatttgagttatttttattgtatgcccggagtttgcatgagattttttctcatcacctttgtataaaaaatttttaattttttttaatcaataaatattttaaaccag

SEQ ID NO: 192089 - DNA, 6061 bp, Homo sapiens
  Payload ID: 17959
  Gene Name: transcription factor 12
  Uniprot ID: Q99081
  ENST ID: ENST00000267811
  CDS Start-End: 305-2353
cgcggagggatccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagtaaaatagtgagttttttacatttctctttctcaaataataatgtattttgttttattttctccatctcattcgtcccagaaacactcacactgcttttcctaactgcattaccgacattatctgggaaacccttcaggacagaatcaggcttgtggagctaagttggcaatctggtctagagcttctctagcttgtgcttttctcctcttgccctcactactgacggtggccttttaaccttttcctaaagattgaccaaacagcaactagtagttatagaaaatctactcatttgtagatacagagaaaaatgaagaagatggaaaaagactcaaaagaggctttttaagttattcttcaaagcacttttcacatttccccataccctttctcacaaaaaaagtgtcataattaagtaatggtattgtttactgtttaaaagttaaaagatcaaaaatttgcttttatcccagtttttaaccacaaaaaaaagcgtagggattatccatgaggacttcatgccaagcaagaacctcaaacaaactagacaaactttttttttgacagtgaatgactttttgtaggacctgtgcgtgcgaaacccatggcaattgtcacatcctcttggtatgctggcagattgcttctcttggtgaattatgaaatccactgttcacattgggtgcctaacagaacattttgcttcttgtgggatttagtgaaaactattaaacttgttaagttgattttatacaaaacgataaataaaaagctctaagaagaaaatgtataatcttagagctgaaataaaatatagagaccatctagtaaatgacctcattaatatatctgtgaaaactgagactcagattgtatgtctctaagaacacataattagtaacagatcaagacacttaaaactttccctacaaaacctccctgccttgactttctctttctctttgcagatttctaggccgcttctgctcagtgtcttcattttcttccatatttgttttatttcatttttcttttctatagttcatgttttctttttccttggaaactcaaaatttaaacacacgtcgtgtgtgtgtgtgtgtgtgtgtctgtgtgtgtgtgacttaaagaatcttaagctttggcattaaatagtcctcgattcaaatctaagctcaacatctgattaacttcattttcctatctgaaaaatggagataacattagaattgtgtaagtattgaatgaaacaatgtatggaaagctcttatggttcttgtcacctaagaagtacttaataaatgataaatatttttaaataaataatattataaccaa

SEQ ID NO: 192090 - DNA, 4719 bp, Homo sapiens
  Payload ID: 17959
  Gene Name: transcription factor 12
  Uniprot ID: Q99081
  ENST ID: ENST00000333725
  CDS Start-End: 236-2356
agagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaa

SEQ ID NO: 192091 - DNA, 3956 bp, Homo sapiens
  Payload ID: 17959
  Gene Name: transcription factor 12
  Uniprot ID: Q99081
  ENST ID: ENST00000343827
  CDS Start-End: 57-1595
gtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatctttttttt

SEQ ID NO: 192092 - DNA, 4786 bp, Homo sapiens
  Payload ID: 17959
  Gene Name: transcription factor 12
  Uniprot ID: Q99081
  ENST ID: ENST00000438423
  CDS Start-End: 297-2417
ggcgcggagggatccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagt

SEQ ID NO: 192093 - DNA, 1809 bp, Homo sapiens
  Payload ID: 17959
  Gene Name: transcription factor 12
  ENST ID: ENST00000543579
  CDS Start-End: 93-1703
actgaagacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggaggg

SEQ ID NO: 192094 - DNA, 1598 bp, Homo sapiens
  Payload ID: 17959
  Gene Name: transcription factor 12
  Uniprot ID: Q99081
  ENST ID: ENST00000537840
  CDS Start-End: 146-1486
agacttactccctttgcctgtgtggatatatgtcttggagagaggctgtgtgcattagctacaaatagtaacattttcaaaatcaacatgtattgtgcttatcctgtccctggaatgggcagcaattctttgatgtattactacaatgggaaaacggtatatgcaccatccccaaattcagatgatttcaaccgtgaatctcctagttatccatctcctaagccaccaaccagtatgttcgctagcactttctttatgcaagagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaaga

SEQ ID NO: 192095 - DNA, 1314 bp, Homo sapiens
  Payload ID: 17959
  Gene Name: transcription factor 12
  ENST ID: ENST00000559710
  CDS Start-End: 51-1001
gcagttgggcagcggttttacctccattttgagaccagacaactggactcatgtcttccaactcaagtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtgg

SEQ ID NO: 192096 - DNA, 675 bp, Homo sapiens
  Payload ID: 17959
  Gene Name: transcription factor 12
  ENST ID: ENST00000561152
  CDS Start-End: 398-574
attgcccctcaccccgctcctcgagaccccagccgcggccgggcccggcgcgcggagcacccggcggcggcgcggagcagggggcgccgaggaggtggcagagactggctcggaaacttgggggagaggcggcgagttgcgggagccgccgcgtcgatctcgggccgcggcgaggaacgcgtggattccgggacccggcgcgggcactgagccctcccgccccttgctcgcgccgcggtgggagcgagtcggggtcctggaagtcatcccggcgcccccagcgctcttgcgtaatcttccccagtacctctctctgttccctcacacactttgggcctcggtggtctctcgctgagcccgtttcctctgccctaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcagggttttacagacagccctcattacagtgatcacttgaatgacagtcgattaggagcccatgaaggcttgtccccaacacctttcatgaactcaaatctgatgggaaaaacatcagagagaggctcatttt

SEQ ID NO: 192097 - DNA, 4076 bp, Homo sapiens
  Payload ID: 17959
  Gene Name: transcription factor 12
  Uniprot ID: Q99081
  ENST ID: ENST00000557843
  CDS Start-End: 88-2136
ggggaagcccaagcccgttctcccggccaaagtgaactttaatcggggtggttggatgcggagacggggcggcagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaa

SEQ ID NO: 192098 - DNA, 2252 bp, Homo sapiens
  Payload ID: 17959
  Gene Name: transcription factor 12
  ENST ID: ENST00000559609
  CDS Start-End: 255-2252
gaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtacaatacacgagatgaagcagttaaatagcaaagcaagacagaagggtcagagaattaaaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgcctt

SEQ ID NO: 192099 - DNA, 1544 bp, Homo sapiens
  Payload ID: 17959
  Gene Name: transcription factor 12
  ENST ID: ENST00000559703
  CDS Start-End: 26-1045
attttgagaccagacaactggactcatgtcttccaactcaagtaccagtcagtggccaagacctggagggcaagcaccttcatccccaagctatgaaaactcactccactccctgaaaaatcgagttgagcagcaacttcacgagcatttgcaagatgcaatgtccttcttaaaggatgtctgtgagcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattg

SEQ ID NO: 192100 - DNA, 575 bp, Homo sapiens
  Payload ID: 17959
  Gene Name: transcription factor 12
  ENST ID: ENST00000557947
  CDS Start-End: 104-575
gactcgggccggcgcccaggctccggggcgcgcgggagatcgggcggcttcggccgcggagccaggctcattgttcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactatt

SEQ ID NO: 192101 - DNA, 212 bp, Homo sapiens
  Payload ID: 17959
  Gene Name: transcription factor 12
  ENST ID: ENST00000560836
  CDS Start-End: 1-145
agagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccaggaggagaggctatgggagcctcaggtaccgagcatctggtgtctggagagatgcag

SEQ ID NO: 192102 - DNA, 440 bp, Homo sapiens
  Payload ID: 17959
  Gene Name: transcription factor 12
  ENST ID: ENST00000560948
  CDS Start-End: 1-133
taaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccaggttgtctttgaagggagacctcaggtgcacctcatggcttccacagcacctcatcttcctacaaaagagcaaaataaaaccaaagggtcttctgaagtcactgagacaatagctgatctcattgggccaatgagtcttctaaaaattgcagttccttctcccttggcattccacagtcaagtaaacttacacgtattgtctggaagaatgaatcccattcctcctccatcttctttggctctggtgtgggcttatgtaatctggatacaatcccataaagttgctgtgtttagtaa

SEQ ID NO: 192103 - DNA, 1555 bp, Homo sapiens
  Payload ID: 17960
  Gene Name: transcription factor 15 (basic helix-loop-helix)
  Uniprot ID: Q12870
  ENST ID: ENST00000246080
  CDS Start-End: 162-761
ggccgggcggagccctccgcccccggccggggcggccttgccattggcccctccctcgcctataaggcgggggccggcggggccgtgggagcgcgcgggagcgcacggcggggcgcggccgacgctgggacgcggcgcacggagggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagaccgtgcgcctggcgtccagctacatcgcgcacctggccaacgtgctgctgctgggcgactcggccgacgacgggcagccgtgcttccgtgccgcgggcagtgccaagggcgccgtccccgccgccgccgacggcggccgccagccgcgctccatctgcaccttctgcctcagcaaccagcgcaaggggggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataaaagacgtcgttctgagctgaggagagtcccgtggacatcggaggtcagaggtgggccctcccctggacctagagagaggcacagatgttctgggggctgccctgagccctggaagggtgggggtggggcgggggaaggcaggcagagccccctctccgggcgccataaccaaactttcctcagtctgctgtttatcagatgttcttaacaactgttaggtgtctgatatggttggtaaagaaatcttaattttacttatttttgaataaggcctgtgttcatttcattcacatggttcaaaactcagaaggtaccagagggtatgtgttgaaaagtctccgtgcccctgtcctccagccaccagctctcctctctgcaagcagcctagggcaccagtttcctgtgatgtcccattcactatgaatgatcaggcaaatacacaaatgacagcacatcgtacac

SEQ ID NO: 192104 - DNA, 958 bp, Homo sapiens
  Payload ID: 17960
  Gene Name: transcription factor 15 (basic helix-loop-helix)
  ENST ID: ENST00000621005
  CDS Start-End: 30-626
cggcgcacggagggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagaccgtgcgcctggcgtccagctacatcgcgcacctggccaacgtgctgctgctgggcgactcggccgacgacgggcagccgtgcttccgtgccgcgggcagtgccaagggcgccgtccccgccgccccgacgggccgccagccgcgctccatctgcaccttctgcctcagcaaccagcgcaaggggggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataa

SEQ ID NO: 192105 - DNA, 3039 bp, Homo sapiens
  Payload ID: 17961
  Gene Name: transcription factor 19
  Uniprot ID: Q9Y242
  ENST ID: ENST00000376255
  CDS Start-End: 504-1541
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192106 - DNA, 3290 bp, Homo sapiens
  Payload ID: 17961
  Gene Name: transcription factor 19
  Uniprot ID: Q9Y242
  ENST ID: ENST00000376257
  CDS Start-End: 755-1792
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192107 - DNA, 3040 bp, Homo sapiens
  Payload ID: 17961
  Gene Name: transcription factor 19
  ENST ID: ENST00000383526
  CDS Start-End: 504-1541
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcttgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192108 - DNA, 3291 bp, Homo sapiens
  Payload ID: 17961
  Gene Name: transcription factor 19
  ENST ID: ENST00000400401
  CDS Start-End: 755-1792
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcttgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192109 - DNA, 2993 bp, Homo sapiens
  Payload ID: 17961
  Gene Name: transcription factor 19
  ENST ID: ENST00000428957
  CDS Start-End: 457-1494
cccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192110 - DNA, 3040 bp, Homo sapiens
  Payload ID: 17961
  Gene Name: transcription factor 19
  ENST ID: ENST00000446042
  CDS Start-End: 504-1541
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192111 - DNA, 3291 bp, Homo sapiens
  Payload ID: 17961
  Gene Name: transcription factor 19
  ENST ID: ENST00000439112
  CDS Start-End: 755-1792
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggtccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192112 - DNA, 3281 bp, Homo sapiens
  Payload ID: 17961
  Gene Name: transcription factor 19
  ENST ID: ENST00000441405
  CDS Start-End: 745-1782
gggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192113 - DNA, 3040 bp, Homo sapiens
  Payload ID: 17961
  Gene Name: transcription factor 19
  ENST ID: ENST00000453201
  CDS Start-End: 504-1541
aggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggtccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192114 - DNA, 3291 bp, Homo sapiens
  Payload ID: 17961
  Gene Name: transcription factor 19
  ENST ID: ENST00000430947
  CDS Start-End: 755-1792
tccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctgctcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgtgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaagtggggaccacgccttctgctccaccccaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccaccgccaaggcaccatcggacacacctgcccatgagtagacacagcagcgagcaaataggtctgataaataccccccttcccttccctccccaagagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacatccgccctttcctacctagatttaatgagcccaagtttttttacatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 192115 - DNA, 3291 bp, Homo sapiens; identical to SEQ ID NO: 192108
  Payload ID: 17961
  Gene Name: transcription factor 19
  ENST ID: ENST00000446038
  CDS Start-End: 755-1792

SEQ ID NO: 192116 - DNA, 3040 bp, Homo sapiens; identical to SEQ ID NO: 192107
  Payload ID: 17961
  Gene Name: transcription factor 19
  ENST ID: ENST00000416433
  CDS Start-End: 504-1541

SEQ ID NO: 192117 - DNA, 2993 bp, Homo sapiens; identical to SEQ ID NO: 192109
  Payload ID: 17961
  Gene Name: transcription factor 19
  ENST ID: ENST00000449558
  CDS Start-End: 457-1494

SEQ ID NO: 192118 - DNA, 3281 bp, Homo sapiens; identical to SEQ ID NO: 192112
  Payload ID: 17961
  Gene Name: transcription factor 19
  ENST ID: ENST00000442190
  CDS Start-End: 745-1782

SEQ ID NO: 192119 - DNA, 805 bp, Homo sapiens
  Payload ID: 17961
  Gene Name: transcription factor 19
  ENST ID: ENST00000542218
  CDS Start-End: 1-654
actttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaactggcacatccaagggatgcagagcatcgtgaaaggacagaaagagagaccctggcctcgagaacacctgtcaggttatgaagaggcatcctaattgatttttaaattcaagagatttatcgagcaccttctataagccagcggctatacaaagtggacaaagagccctgacatccagcatgacagaagtgctatttggcacttgttcttcaagttgcccacttggatctcttccaagtgcactt

SEQ ID NO: 192120 - DNA, 6237 bp, Homo sapiens
  Payload ID: 17962
  Gene Name: transcription factor 20 (AR1)
  Uniprot ID: Q9UGU0
  ENST ID: ENST00000335626
  CDS Start-End: 136-5952
tgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatat

SEQ ID NO: 192121 - DNA, 7410 bp, Homo sapiens
  Payload ID: 17962
  Gene Name: transcription factor 20 (AR1)
  Uniprot ID: Q9UGU0
  ENST ID: ENST00000359486
  CDS Start-End: 138-6020
tctgggcctctgattcatctttattccctccatcatctagacttgattttatttgtaccaaggagatgcgtgtctaatgtttttctttcttctatttctaggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcagcaggattacactgggcctttctctccagggagtgctcagtaccaacagcaggcttccagccagcagcagcagcagcaagtccagcagttgagacaacagctttaccagtcccatcagcccctgccacaggccactggccaaccagcatccagctcatcccatctacagccaatgcagcggccctcaactctgccatcctctgctgctggttaccagttaagagtgggtcagtttggccaacactatcagtcttctgcttcctcctcctcctcctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttg

SEQ ID NO: 192122 - DNA, 1058 bp, Homo sapiens
  Payload ID: 17962
  Gene Name: transcription factor 20 (AR1)
  ENST ID: ENST00000404876
  CDS Start-End: 1-753
atggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaa

SEQ ID NO: 192123 - DNA, 633 bp, Homo sapiens
  Payload ID: 17962
  Gene Name: transcription factor 20 (AR1)
  ENST ID: ENST00000515426
  CDS Start-End: 175-633
cggccgcggggcgcacggcccggagcgcgcggcccgcgcccccgcgcgccctgctcgcgcccgcgccccgcgctccggagcccggccccgctgcccgggctctcctgcgggaccgatgccggccctccggccgccagggagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcag

SEQ ID NO: 192124 - DNA, 1058 bp, Homo sapiens; identical to SEQ ID NO: 192122
  Payload ID: 17962
  Gene Name: transcription factor 20 (AR1)
  ENST ID: ENST00000574269
  CDS Start-End: 1-753

SEQ ID NO: 192125 - DNA, 7410 bp, Homo sapiens; identical to SEQ ID NO: 192121
  Payload ID: 17962
  Gene Name: transcription factor 20 (AR1)
  Uniprot ID: Q9UGU0
  ENST ID: ENST00000574943
  CDS Start-End: 138-6020

SEQ ID NO: 192126 - DNA, 6237 bp, Homo sapiens; identical to SEQ ID NO: 192120
  Payload ID: 17962
  Gene Name: transcription factor 20 (AR1)
  Uniprot ID: Q9UGU0
  ENST ID: ENST00000576946
  CDS Start-End: 136-5952

SEQ ID NO: 192127 - DNA, 495 bp, Homo sapiens
  Payload ID: 17962
  Gene Name: transcription factor 20 (AR1)
  ENST ID: ENST00000574164
  CDS Start-End: 37-495
gagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacctctggccatcaaggttaccagggtttcaggaaagaggctggagatttttactacatggcaggcaacaaagaccccgtgactacaggaaccccacagcctcctcagcgaaggccttctgggcctgtgcagagctatggacccccccaggggagcagctttggcaatcagtatgggagtgagggtcatgtgggccagtttcaagcacagcactctggccttggcggtgtgtcacattatcag

SEQ ID NO: 192128 - DNA, 6237 bp, Homo sapiens; identical to SEQ ID NO: 192120
  Payload ID: 17962
  Gene Name: transcription factor 20 (AR1)
  Uniprot ID: Q9UGU0
  ENST ID: ENST00000619505
  CDS Start-End: 136-5952

SEQ ID NO: 192129 - DNA, 7410 bp, Homo sapiens; identical to SEQ ID NO: 192121
  Payload ID: 17962
  Gene Name: transcription factor 20 (AR1)
  Uniprot ID: Q9UGU0
  ENST ID: ENST00000621408
  CDS Start-End: 138-6020

SEQ ID NO: 192130 - DNA, 1058 bp, Homo sapiens; identical to SEQ ID NO: 192122
  Payload ID: 17962
  Gene Name: transcription factor 20 (AR1)
  ENST ID: ENST00000626821
  CDS Start-End: 1-753

SEQ ID NO: 192131 - DNA, 633 bp, Homo sapiens; identical to SEQ ID NO: 192123
  Payload ID: 17962
  Gene Name: transcription factor 20 (AR1)
  ENST ID: ENST00000628031
  CDS Start-End: 175-633

SEQ ID NO: 192132 - DNA, 6237 bp, Homo sapiens; identical to SEQ ID NO: 192120
  Payload ID: 17962
  Gene Name: transcription factor 20 (AR1)
  Uniprot ID: Q9UGU0
  ENST ID: ENST00000629538
  CDS Start-End: 136-5952

SEQ ID NO: 192133 - DNA, 1058 bp, Homo sapiens; identical to SEQ ID NO: 192122
  Payload ID: 17962
  Gene Name: transcription factor 20 (AR1)
  ENST ID: ENST00000631350
  CDS Start-End: 1-753

SEQ ID NO: 192134 - DNA, 495 bp, Homo sapiens; identical to SEQ ID NO: 192127
  Payload ID: 17962
  Gene Name: transcription factor 20 (AR1)
  ENST ID: ENST00000630841
  CDS Start-End: 37-495

SEQ ID NO: 192135 - DNA, 633 bp, Homo sapiens; identical to SEQ ID NO: 192123
  Payload ID: 17962
  Gene Name: transcription factor 20 (AR1)
  ENST ID: ENST00000630248
  CDS Start-End: 175-633

SEQ ID NO: 192136 - DNA, 7410 bp, Homo sapiens; identical to SEQ ID NO: 192121
  Payload ID: 17962
  Gene Name: transcription factor 20 (AR1)
  Uniprot ID: Q9UGU0
  ENST ID: ENST00000628774
  CDS Start-End: 138-6020

SEQ ID NO: 192137 - DNA, 7410 bp, Homo sapiens; identical to SEQ ID NO: 192121
  Payload ID: 17962
  Gene Name: transcription factor 20 (AR1)
  Uniprot ID: Q9UGU0
  ENST ID: ENST00000626726
  CDS Start-End: 138-6020

SEQ ID NO: 192138 - DNA, 6237 bp, Homo sapiens; identical to SEQ ID NO: 192120
  Payload ID: 17962
  Gene Name: transcription factor 20 (AR1)
  Uniprot ID: Q9UGU0
  ENST ID: ENST00000626486
  CDS Start-End: 136-5952

SEQ ID NO: 192139 - DNA, 1058 bp, Homo sapiens; identical to SEQ ID NO: 192122
  Payload ID: 17962
  Gene Name: transcription factor 20 (AR1)
  ENST ID: ENST00000627133
  CDS Start-End: 1-753

SEQ ID NO: 192140 - DNA, 633 bp, Homo sapiens; identical to SEQ ID NO: 192123
  Payload ID: 17962
  Gene Name: transcription factor 20 (AR1)
  ENST ID: ENST00000635187
  CDS Start-End: 175-633

SEQ ID NO: 192141 - DNA, 1058 bp, Homo sapiens; identical to SEQ ID NO: 192122
  Payload ID: 17962
  Gene Name: transcription factor 20 (AR1)
  ENST ID: ENST00000635629
  CDS Start-End: 1-753

SEQ ID NO: 192142 - DNA, 6237 bp, Homo sapiens; identical to SEQ ID NO: 192120
  Payload ID: 17962
  Gene Name: transcription factor 20 (AR1)
  ENST ID: ENST00000635421
  CDS Start-End: 136-5952

SEQ ID NO: 192143 - DNA, 6237 bp, Homo sapiens; identical to SEQ ID NO: 192120
  Payload ID: 17962
  Gene Name: transcription factor 20 (AR1)
  ENST ID: ENST00000634489
  CDS Start-End: 136-5952

SEQ ID NO: 192144 - DNA, 7410 bp, Homo sapiens; identical to SEQ ID NO: 192121
  Payload ID: 17962
  Gene Name: transcription factor 20 (AR1)
  ENST ID: ENST00000635146
  CDS Start-End: 138-6020

SEQ ID NO: 192145 - DNA, 1058 bp, Homo sapiens; identical to SEQ ID NO: 192122
  Payload ID: 17962
  Gene Name: transcription factor 20 (AR1)
  ENST ID: ENST00000634848
  CDS Start-End: 1-753

SEQ ID NO: 192146 - DNA, 633 bp, Homo sapiens; identical to SEQ ID NO: 192123
  Payload ID: 17962
  Gene Name: transcription factor 20 (AR1)
  ENST ID: ENST00000635601
  CDS Start-End: 175-633

SEQ ID NO: 192147 - DNA, 7410 bp, Homo sapiens; identical to SEQ ID NO: 192121
  Payload ID: 17962
  Gene Name: transcription factor 20 (AR1)
  ENST ID: ENST00000634616
  CDS Start-End: 138-6020

SEQ ID NO: 192148 - DNA, 3010 bp, Homo sapiens
  Payload ID: 17963
  Gene Name: transcription factor 21
  Uniprot ID: O43680
  ENST ID: ENST00000237316
  CDS Start-End: 64-603
cttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggagtttggtacctggagcgagagcttctccgcccttccaccaaccccacaggccgcttcgcgggtggagccctctgcctggccatggaggaaggatcccgctaggctggtcccgactggagaagctgctctgccaggtgtgctctctgtcagcaatagtgacctcattaccaaggggtggcgaccacattaccaagcgcaattccccattctccaagggctgagaacttcggtgacttcatccacctgtctatttgcacatggaggacttttcaagatgtcaggatacccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgattgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctggttctgcatccaactagctgtttcttgaaagagcctggatcctcagttttcccatctctgcaagcagggataacggtaatgagaatgataataatcattatatgcagaccttcctctttcatcttacagaggcttagtgaggctcagatgagattatatctgtaaaatcccttggtaaaggaaaagctccgtgaaaatgtcagttacttttactaagtggcgggtagtgaattatctgtgcctagacccaaactgaaagtgtctcaggcaggaagttccaagggatgtatgtttatagcatccaggcaatgatctttttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctctcctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatcctgagtccaggagtctgaagtggggccccaggtgatgtcattgctgctggtcccaggaccacattttaacaatcaatgttttcaggtgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacccgggtgtgtggacatg

SEQ ID NO: 192149 - DNA, 4551 bp, Homo sapiens
  Payload ID: 17963
  Gene Name: transcription factor 21
  Uniprot ID: O43680
  ENST ID: ENST00000367882
  CDS Start-End: 261-800
ccacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcgatgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctgacgtggccctttatggtggccgggaaacccgagagtgacctgaaagaagtggtgaccgcgagccgcttatgtggaaccaccgcgtcctgaccttggaggtgcgagtctgggaaaggcgcgctcccggggggagcgggccccgggaaggcgacccctgccctcagtgctctctgtctctgcttccccctcgcaatgctcctctctctgtcccaccccgcgagaacactttacaacgacgaggagattcgtttccaaaccagaggagatcaattgtacttacaaagattcccatctatttaactttattaacttctaccgtgaatgactctgcaagccttgctggtccaagtgcaatatgtaattataaatatataaatagataagagcctatcaatgtatcttttgtacaatatgttgtaaaatgtagatcataggatagctgactttgacagtcacatttataaagtaattcacttaaagatatatatttttttcaaacaagttttgctacttttgaaaataaatctttctttatattgctaaaagctctgatatttggagtgatttttaaaaatatttggaataagaaagtgggaaactatggggaagcttgataatgaaaatggttcttttaaacctcaatctaaacttctagagatagaagaaaattgcatatgagtttcataatgaagatgcagattatgttttatactgaaaccttaaaaaagaaatatatcggttacttttaaggctaatagaaattatataactgaaaacaaagaatgggcagtattaaagttatccacagttatacagttcaagagtaaaacgcaccagaaaaaggaaatccaattttcatggattccaccgtatgactgctgacacgggcgagaaagtaaactccaccttttgtcaccttccaggtgtgagcatagctgcaaactagtgaagaaataatagaagctatgaaagatgtaaattccataacccttagggtgtgtttcaggattttcaaagctctgcagcatacattatctacatttcttattaatagtccattaattaattctaacaataaacccgcatgcctgccttttggttgctgttagcgggtgcgtttagctcccgccacgacttccggcggactgggtttaatttaaacattttccaggctacggaacagctcctaagggaagattaagttgagataaacagagaagcaaggccgaggagcctgcgacccggctccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctctgcctggccatggaggaaggatcccgctaggctggtcccgactggagaagctgctctgccaggtgtgctctctgtcagcaatagtgacctcattaccaaggggtggcgaccacattaccaagcgcaattccccattctccaagggctgagaacttcggtgacttcatccacctgtctatttgcacatggaggacttttcaagatgtcaggatacccttccatcaccccaccaccgccaccccaacttgactttcaagaacacatttcaagctctggccagagtcccgttcctcaaattcatgtgttctctcctttctaccagagggatagagcccatgcctcaacctatccagagttcaaatcaaagagtccccagtgtgattcaattgattgcctttcacgtttcgcaaattttccaatctcccactcacgtttttacaaaacgaatgctctaaattctgaggattccaggcaggccatccatagagaaataactttttcttgctcattcccttacaaccccaatctatacatggatttttagaaagtcttcatggctatctatagttccctaccaataatttgaagcctttgctttaggcaggaggcatgtggctatgaatagggaacacgtagatttgaccctggttctgcatccaactagctgtttcttgaaagagcctggatcctcagttttcccatctctgcaagcagggataacggtaatgagaatgataataatcattatatgcagaccttcctctttcatcttacagaggcttagtgaggctcagatgagattatatctgtaaaatcccttggtaaaggaaaagctccgtgaaaatgtcagttacttttactaagtggcgggtagtgaattatctgtgcctagacccaaactgaaagtgtctcaggcaggaagttccaagggatgtatgtttatagcatccaggcaatgatctttttttttccacgaactaaaatacctctttttggtatctattgactctttctctctctctttctgtctctctttcaccttgcacctctccctaatgctctctaaatttgtccagagctttctttttcctagaaatccagagagcaaagtcagagcctggcacctgcagataggataacactggtgtctgatggtgaggctgcccagtcccatcaggagcctcagccaaggaggggcctgggcacactcaggtccccatggttgtccattgaatggagtgaggatcaaggtgggaatgactgggtggtggctgccactagcccaggaacatgacaacgtgaccacaccacacatgcctccaacacacacccacagtctaaacatctctccttctcagtgagcccttctcccattccagatcatcagcacacccacacccaccataggtctctctcctccggtcttcccagaagggtaaaactcccagcctaccctgctccagcttcagcccaggtagttggtgtgtctcaatatgaatagggggtgagtagcttcatagaaagaatggggaactcccttggcctcaagccagtatagtttggaagttgggggtcggggatgttaagggtggggagtatcctgcctgtgacctctaggttatgaaaactatcttagaaggtgcttttagaaagaaccaggagaacaaccaaagcagcttacagacgcctgaacggagaatgaagtgtttcaagtaagcgagtctgcaagttctcagaagcagacagatatccaatctggactgcagccagggaagtcctctctctcgctctctctctctctctctctctctctcattgcttgtatgacttcacaagcaactcaggatcattctagcaggctttcccactgtcaaacagagacttcattctaaaaagagaagtgataaacagagctccagctctgctagctctatatatttactgattagtggaaagcactgaccaaggagacttttaagccagtggttcttcagaatcacctagatgcctccaccctccagagatcctgagtccaggagtctgaagtggggccccaggtgatgtcattgctgctggtcccaggaccacattttaacaatcaatgttttcaggtgtctcatgaggaacactacttaatgcagtgggaaagaaaatatttcagaggagaattttttcttaaagaagctgcatattctggactctaatttagtttaattcactccaggatggcacgcaggattcctaattcttaaatgccattcagtctggacttcaaatcacttgtcttcagaaaataaaagatttgttccacccgggtgtgtggacatg

SEQ ID NO: 192150 - DNA, 4882 bp, Homo sapiens
  Payload ID: 17964
  Gene Name: transcription factor 23
  Uniprot ID: Q7RTU1
  ENST ID: ENST00000296096
  CDS Start-End: 131-775
gagttggcgccagcttcctcggatgtagatattgctggctggatgaccagccacagccagctagcttgagtccaaggcctcctcaggcactgtgtttctgctctgtgggctgcagccccagtggggtggcatgtcacagaggaaggccagagggccaccagccatgccaggggtggggcatagccagactcaggccaaagcacggttgctgccaggcgctgacaggaagaggagccgcctcagcaggacaaggcaggacccgtgggaagaaagaagctggagcaaccagagatggagcagagctacccctggccctcgagggaccagggctgggggcctggctcttggcaggagcgaggccagtcctgagaatgccgcgcgggagcggagccgggtcaggacgctgcgccaggccttcttggccttgcaggctgctctgcctgccgtgccgcccgacaccaagctctccaagttggacgtgctggtgctcgccgccagctacatagcccacctcacccgcacactcggccacgagttgcctggccctgcctggccgcccttcctgcgtggactccgctacttgcaccctctcaagaagtggccgatgcgatctcgtctctatgctggaggcctggggtactccgatcttgactccaccacagccagcacccccagccaaagaacaagagatgcagaggtggggtcccaagtccctggagaggcagatgctctcctttccaccacaccactctcaccagctcttggtgacaaataattatcacactcgcccttttctcctagactgtgactcatgcttatgggcctggattttctaccagcccccagattctcagccatcagacttgactcagactcagctcccaagttccagcatgcagaccaagagaagcagtagcacttctgtgatggacagtacctagaggggcacaggttggagagcctcctccttggtccccaggaggggacttccccatggctcttctgtgacagctactgggaagtgggagagaaagaggtataattgggctcaaagttgaggtagggaaccaccctagctttcttcccctaaggtttctacaaaccctctgcagatagcaaaaaggcaggtgcagagggaggggcctgggatggcaccagccccaggtgctgatgggaaagccaggtggccggataggctcctggtagctccaagtgtaaacagatctgggctgggtcacacagccagaggggaaactgaagaaggaaatgtgctttctaactgcatcatgagatgcttacctgatgttagagagatagtgaggaattcaggattcctccctctgtagtatgggcctttccagaagctgcccctcaccactacattttctctccctctcggctcctgcactcttccactcttttcttttcttttcttttcttttcgtttcttcttctttttatgtagagatgggggtcttgatatgttgcccaggctggcctcgaacccctggcctcaagtgatcctcccacctcagcctcctaaagtgctgggattacaggcatgagccaccatgcccaaccccactgttttcttgacatgagttatatctacaggttaagccatacatcttgcattgcttacattccagtttccagagaaacttttagatagtcccagatgcctagtttgagatcttaaccagaagcaattctaccttaattgaaccaagcagcaacttatggccttaaatatgaaggatattgacagaatcaattacatccttgaaggaccttaagagaagatcaggtatatagggggtgatcattacagtcttctctttccattatgttagaaacctgccctcaagcaaaaacaagataggcctgccttcaactgctcaaccactcaattggctccttgtaaaatttgtgttcgaggcttccctggctctggagttatttctatagtctattagctccctagggccggctccgcctcatggagatcgtccttgggggctttctctaagtcctaccatggggtgccagaaatgtgatatagcttcggtgaaactcatctctggccctaaagaaataacttgaggactaatcatagaatctacacacactgaaaataactttccagatcggatgtagcctcaaacctggcacctgaagtccagatggaacaaattacctttcggttaaatttcagcccttcagagtgggaggggacgggcatgaccaactagagtcccaacaaggttatccttagacacacaccattgttgttatcatgaatgtaagtgagctctgggcaggctgggaatggttggggtctgggttctggcatgacaggaccctgtacctccacagggctggccagggcagagctgaaatagggctgggggtgcgactgagccagttgtggtagaggtagaaaaagagacacagaacatcccagccccgagctgcctgggatgtgggagaacagctggaatgtggatgggagccatggggagaaggcctcggccaaggctgaactcgtaaatctgccttgaaccacgtctctgcagagggaccctgaagagcttgtgcagagctgatgtgggcagctggacagggccaggcaggggcagaggccaggtgtgggagggcatgagcacagtgttcttcacaagaccataaaagtccagctagaatgtactatttttaaagccaaacagcagtatcttcctggttgagttcacgggagtgctaggaagagaagcagatacatttcctcctcagttggtggcacactttcctggggatgaagggaaattggcttggggtgtgtgtcggggtcctctggatagcatggagcttctcctgataatagagtagactttgggttggagcttgccccaccctgtcctgctcagactcaggcctttgcctagtaacattagagccctcaggggtgaccgcatggccctggtgtagacaaggagggcacaggaaggatgacgcaggtggagggctgcaggaggcaggtcccatcgctacaagtttctcagggtgtcttgggccctttccaggcaaagctgttctcctttgtgcccaggacagtcgaggggggtggggcagaggccatctcctccagccacagagacccagccccgtcaggccagcaagcaaaggggcctggcagggggcagggtgagccaagggaaggcctaggggatggatgggaataaccagaggatggactgggccctccctccctgacaagcacagtaatgcccttgagacatgtcaggacttggatgcgtgaatgaaccagaagtaacccgctttgtctctgcaatgagaaagaaaaacacagccaggctcagtggctcatgcctgtaatcccagcactttggggagtcgaggcgggcggatcatgaggtcaggagttcgagaccagcctcgccaacatgatgaaaccccttctttactaaaaatacaaaaattagccagatgtcgtagtgggcacctgtaatcctagctacttgggaggctgaggcaggagaattgcttgaacctaggaggcggaggttgcagtgagccaagatcacgccactgcactccagcctgggcgacagagcaagaccccatctcgggaaaaaaaaatgaaagaaaaaaaaagaaaagaaaagaaataaaagaaaatatggatgaaaacatttgagcatggatgacaaatgacactagggtggcctggctcaggagttggaggctcagctgctccataggggattggcctggcctacctggtcttcctgcaccacctgccccatccccaggacttgggattgggatggaggtggaggtggggaacaagacttccctgctggctccctccacagagcatgtgctttctgaggaacaggatggcagggtggaggcttagatggggctgtggggctgggtgtggtggctgatgcctgtaatcccagcactttgggaggccggggtcgggggtggatcatctgaggtcaggagttcaagaccagcctgaccaacatggtgaaaccctgtctctactaaaaatacgaaattagctgggtgtggtggcacatgcctataaccccagctacttgggaggctgaggcaggagaattgcttgatcccaggaggtggagtttgcagtgagctgagattgtgccattgcactccagcctgggcaacaagagtaaaactccgtctaaaaaaaaaaaaaaaatgcggctgtgggagaagcagagctggcccagtgatttctttttttttgttttttgagacagagtctcactctgtcaccgaggctggagcgcagtggcgtgatctcggctcactgcaagctccgcctcctgggttcacgcgattctcctgcctcagcctcccgagcagctgggactacaggcacccgccaacacgcccggctaatttttttttttttttgtatttttagtagagacggggtttcaccatgttagccaggatggtcttgatctcctgacctcgtgatccgcccgcctcggcctcccaaagtgctgggattacaggcatgagccaccgcacccggctggcccagtgatttctaagtaatacagtggacactggattttaccaaattgggaactagagaagtagaggatctagccttctctgagactccttttctcttcctctgggaggagcctggctagggtgagtcagatggcactgtcctctcccttttgtggcatgagccctaaacccagggcccctaaaagcttattctattctagatcaaggtaggcaaactatggccagtgggccaaacccagccccccatgtatttttgtaaataaagttttattggaacacatccaca

SEQ ID NO: 192151 - DNA, 2450 bp, Homo sapiens
  Payload ID: 17965
  Gene Name: transcription factor 24
  Uniprot ID: Q7RTU0
  ENST ID: ENST00000563496
  CDS Start-End: 397-900
agccgcctcagcccccggcgtagcctctccggtgggccaggtcctccgcccgacctgccttagccggtcggagcacacacgcctggccgcggggcgcccgcataaaagtcacagccagcggaggttggaaacagccgtcgacttgggcatcggccggacgaggatggagtgaccagcgcggccctggccacacaggccctgctccacgcccctcgcccgccctcacgacggagcggagctccactcagccgctccaggaaaggaagcccaagaactccggagttccgcaactctccccagacgtccggaagcaaatcgcgtcccaggcaaaacgagctcgcttgagagcgcccttagccccgttgggctgctgcgcgcgcggcgcgggaagctgccatggaccgcggccgcccagcgggcagccccctcagcgccagcgccgagcccgcgcccctggccgccgccatccgcgactcgcgtcccgggcggaccgggccggggccggcgggccctgggggcggctcgcgttccgggagcgggcggccggcggcggcgaatgcggcgcgggagcgcagccgggtgcagaccctgcggcacgctttcctggagctgcagcgcacgctgccgtccgtgccgcccgacaccaagctgtccaagctggacgtgctgctgctggccaccacctacatcgcgcatctcacccgcagcctgcaggacgacgccgaggcgccggcggacgccgggttgggcgccctgcgcggcgatggctacctgcacccggtcaagaaatggcccatgcgatcaagattgtacatcggtgctactggtcagtttctgaagcattctgtttctggagaaaaaacaaatcatgacaacactccaacagactcacagccttaggctctcccctggtgggggctggtagaagtggtggctattgtttttaaatactatgacataattctatatttattatatgagacataacaaaatttctgaaagtttacatgtgaacccatagttggatgttcaggtttatctgtctaaatgtggaatgaaataatcagtgttatataaaacacacagcttatctgttcagtgtgagagtcactactatatagtgcaagagaaattattagaaaaaagtcacatgaaagcaaacaattgtgtatatagctaaagaatgcaatatagatattgctatagtgtatctattacaaacagaaaagttcatatctattggtgcagtcttcctagtttaaaaagataaaaatctgtgtttataatatacgagtattccttttttgtgaaaaccatactgttcttaagttgatctaagacaccatttcaattgaagaaaactgttgcagtaatatgaagatgcaataaattcaataagtagttacttttccctcttagaaaacttgtttggagtattagaaatggtttgctcagaggacagggcttggtcaccttcctagagggttattctgtatcttacagtgtttgcaacttgtggaaggcactgggaatccctgcagtccagtgtgaacaggagaccaggtgtcagcggacagcagagttcacaatgtaggtgcatgtcaccacacctggctaattcttttattttttgtagagatggagtctcactgtgttgcctaggctactcttgaaatcctggctcaataaatcctcctgcctcacctaccaaagtgttgggattataggctagagccaccgtgcctggcccagttttattgttttaatgtgaatatactcataatgtgacagaagcatatctttttgcaagaaagatatataatagttctctacatattaatatgtagaaaagtacttgcatatttaaatatttgtaaacatatttacctactcatggaaagaaataaaaagtaaaatgagatttggattcagccattcactattataagttattgacataagaagtgctaaaaagaatctttatcctaaggaatgaaatcaaaacttcttcaaagttacctcaaactgaattgtaaacactaaatttaacagcaagaatttcagaaaaatgattttcttgctaataattcttaagatttattagtttggctagtttttaaagcatttaactggggaaaaaactatgtgttgaataattagatttctaagtcatcctgttaaatagttagtagagctttgcctttgatggtattactttttaattcttctcatccagttacaagttgtattaatgccaaagaagtgtatttgttacagattttcataacattttattaaattgctagatatgatgataggttttggtatgtttacagaggagaaattgcatattttcactcagattcaaaagagcatgctcttttaatgctttaatggtgaatggtcatgataagaggtattataaaaataaagtactaatttgaaaatta

SEQ ID NO: 192152 - DNA, 2233 bp, Homo sapiens
  Payload ID: 17966
  Gene Name: transcription factor 25 (basic helix-loop-helix)
  Uniprot ID: Q9BQ70
  ENST ID: ENST00000263346
  CDS Start-End: 57-2087
ccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgctc

SEQ ID NO: 192153 - DNA, 2377 bp, Homo sapiens
  Payload ID: 17966
  Gene Name: transcription factor 25 (basic helix-loop-helix)
  ENST ID: ENST00000263347
  CDS Start-End: 788-2209
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggaagggagaggaggagaggaacagtgttatttgggggtcacagctctgcgtttgcaggccacgttctttcccatctccaccgaatgtacaagcgcttgcgtgtcggcctctgtggcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgctc

SEQ ID NO: 192154 - DNA, 655 bp, Homo sapiens
  Payload ID: 17966
  Gene Name: transcription factor 25 (basic helix-loop-helix)
  ENST ID: ENST00000565196
  CDS Start-End: 25-655
cagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacaggccacggcagagacaacgtgtgtaccccaagtgcacatggctgaccacccctaaaagcacctggccccgctacagcaaaccag

SEQ ID NO: 192155 - DNA, 515 bp, Homo sapiens
  Payload ID: 17966
  Gene Name: transcription factor 25 (basic helix-loop-helix)
  ENST ID: ENST00000566283
  CDS Start-End: 1-352
gaagggagaggaggagaggaacagtgttatttgggggtcacagctctgcgtttgcaggccacgttctttcccatctccaccgaatgtacaagcgcttgcgtgtcggcctctgtggcaggtgcgagtgacacagtggaagcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtca

SEQ ID NO: 192156 - DNA, 1879 bp, Homo sapiens
  Payload ID: 17966
  Gene Name: transcription factor 25 (basic helix-loop-helix)
  ENST ID: ENST00000562256
  CDS Start-End: 1-1711
gggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtggttctgctccagacgagcccttaccacgttgactcactcctgcagctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataagccagccccctgccctgagccagctggtgaacctgtaccttgggaggtcacactttctctggaaagagcccgccaccatgagctggctggaggagaacgtccacgaggttctgcaagcagtggacgccggggacccagccgtggaagcctgtgagaaccggcggaaggtgctctaccagcgtgcacccaggaatatccaccgccatgtgatcctctctgagatcaaggaagccgtcgctgccctgcccccggacgtgaccacgcagtctgtgatggggtttgatcctctgcctccttcggacacaatctactcctacgtcaggccagagaggaagggagaggaggagaggaacagtgttatttgggggtcacagctctgcgtttgcaggccacgttctttcccatctccaccgaatgtacaagcgcttgcgtgtcggcctctgtggcaggctaagtcctatcagccatggaaacaccattgctctcttcttccggtcactgttgccaaactataccatggagggggagaggcccgaggaaggagtggctgggggtctgaaccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggtcacgctc

SEQ ID NO: 192157 - DNA, 860 bp, Homo sapiens
  Payload ID: 17966
  Gene Name: transcription factor 25 (basic helix-loop-helix)
  ENST ID: ENST00000564652
  CDS Start-End: 25-255
cagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctggaaaaatggacattttcctctccccctaaaaaaagataaaactccttcctggttattaactgaaatgctgatcgagctttatcctaaagaagatcagtcgtggacaagaaccttgtgaaatgttccccatttgagaccctaaaactaatgaaaatcacagcttttggataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaaggccacggcagagacaacgtgtgtaccccaagtgcacatggctgaccacccctaaa

SEQ ID NO: 192158 - DNA, 627 bp, Homo sapiens
  Payload ID: 17966
  Gene Name: transcription factor 25 (basic helix-loop-helix)
  ENST ID: ENST00000562193
  CDS Start-End: 1-627
agcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttctttggacccaatgctgaaataaggctcacggcacatacctgtgtgccccagccccacgccctcaggccagcagcccaggggcctcctttcactccaggccacagggcactccctggaccccccgtctgcccatccatggggctctgccagcctcgaggcaggctgtggtctgaagaggggttctgctcagagcccttgctctcccccagccagccccctgccctgagccagctggtgaacctgtacc

SEQ ID NO: 192159 - DNA, 477 bp, Homo sapiens
  Payload ID: 17966
  Gene Name: transcription factor 25 (basic helix-loop-helix)
  ENST ID: ENST00000565404
  CDS Start-End: 1-440
agaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacaggtgtggcccccgcccttctctgcggctgcccttctctgcggctgcccttctctgcggctgcccttctctgcggctgcccttctctgtggctgccacagagacttcgtgggaggaaaaggttctctaaaaaaggaaaaataaaatgtactgtctttatttaaaaa

SEQ ID NO: 192160 - DNA, 763 bp, Homo sapiens
  Payload ID: 17966
  Gene Name: transcription factor 25 (basic helix-loop-helix)
  ENST ID: ENST00000561958
  CDS Start-End: 63-763
cgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggccacggcagagacaacgtgtgtaccccaagtgcacatggctgaccacccctaaaagcacctggccccgctacagcaaaccaggtctgtccatgcggctgctggaatcaaaaaaaggcctctc

SEQ ID NO: 192161 - DNA, 857 bp, Homo sapiens
  Payload ID: 17966
  Gene Name: transcription factor 25 (basic helix-loop-helix)
  ENST ID: ENST00000568409
  CDS Start-End: 1-857
cagacacttgaatccagacacagaactgaaaaggtattttggtgcccgggcaatcctgggggagcaaaggccacggcagagacaacgtgtgtaccccaagtgcacatggctgaccacccctaaaagcacctggccccgctacagcaaaccaggtctgtccatgcggctgctggaatcaaaaaaaggcctctccttctttgcgtttgagcacagtgaggagtaccagcaggctcagcacaagttcctggtggccgtggagtctatggagccgaacaacatcgtgctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacaggagcttctacctggccctctacaagcagatgagcttcctggagaagcgaggctgcccgcgcacggcgctggagtactgcaagctcatcctgagtctcgagccggatgaggaccccctctgcatgctgctgctcatcgaccacctggccttgcgggcccggaactacgagtacctgatccgcctcttccaggagtgggaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggagtcctcctgcccctgctcgagtcttgcagtgtgcggcccgacgccagcgtttccagtcaccgcttct

SEQ ID NO: 192162 - DNA, 797 bp, Homo sapiens
  Payload ID: 17966
  Gene Name: transcription factor 25 (basic helix-loop-helix)
  ENST ID: ENST00000568412
  CDS Start-End: 1-797
atgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaagtgaggagtaccagcaggctcagcacaagttcctggtggccgtggagtctatggagccgaacaacatcgtgctcagcgatgcctgccgctttcaagaggatcaggagatggctcgagacctcgtagagagagcgctgtacagcatggaatgtgcgttccaccccctgttcagtctcaccagtggggcctgccggctggattaccgcagacccgagaacag

SEQ ID NO: 192163 - DNA, 2047 bp, Homo sapiens
  Payload ID: 17966
  Gene Name: transcription factor 25 (basic helix-loop-helix)
  ENST ID: ENST00000614813
  CDS Start-End: 28-678
ctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagtcaacaaccgcttcgagctgataaacattgacgatcttgaggatgaccctgtggtgaacggggagaggtctggctgtgcgctcacagacgctgtggcaccagggaacaaaggaaggggtcagcgtggaaacacagagagcaagacggatggagatgacaccgagacagtgccctcagagcagtctcatgcaagtggcaaactccggaagaagaaaaaaaaacagaaaaacaagaaaagcagcacgggagaagcatcggaaaacggactagaagatatcgatcgcatcctagagaggattgaggacagcactgggttgaaccgtcccggcccagctcccctgagctccaggaagcacgttctctacgtggagcacagacacttgaatccagacacagaactgaaaaggtattttggtgcccgggcaatcctgggggagcaaagagacagggtcttgctgggttgtccagtctggttttgaactcgtggcctcaagtgatcctcccatctcagtctcccaaatagctgggactaccggcacatgccaccgctaatttattttattttattttttatagaaacaaggtcttactttgttgcccagggtgatgtcaaactcctggcttcaagcgattctcctccctctacctcctaaagtgctaggattacaggcatgagccaccacgcccagccagacacatcctgttttattggaccatggagagtattgctggtctataacatgccctgggtttgcacgtctgagttcttttttttttttttcgagacagaattttgctcttgttgcccaggctggagtgcaatggctcaatcttggctcaccacaacctccgcctcccgggttcaagtgattctcctgcctcagcctcctgagtagctgggattacaggcatgtgccaccatgtccagctaattttgtgtttttagtagagatggggtttctccatgttggtcaggctcgtctcgaactcccaacctcaggtgatccacccgcctcagcctcccgaagtgctgggattacaggtgtgagccaccgtgcctggtctgcacgtctgagttctaagcattgttttctttttttgaaatggagtctcgctctgtcacctaggctctggagctcagtggtgcgatctcagctcactgcaacctccgcctcctgggttcaaacgattctcctgcctcagcttcccaagtagctgggattacaggcgagtgccaccatgctcggcaaatttttgtatttttggtagagacggggtttcaccatgttggccaggctggtctcgatctcctgacctcaagtgatccgccagtctcggcctcccaaagtgctgggattacagccctgagccactgcgcccggcctcccaaagtgctgggattacaggcgtgagccaccacacccagcctaagtgttgtttctgcaccatggtatacccaggtcatttcctcaccccaatggtagcatgtgtccagatgttggctacagtccccggtgtctgcaggcatttctgtgaaactgcccaagaatgagtatatatcctgcatgctgccagtgccttcagtagagttacgtggctcacactgagtgtctgcccaggtccttcaccttcttactcgtagtcgacggtagtggtttggaaacctgccgtcgtgtgtgggcagaagtgttggggttttgattgtgggtagatcaaggatgttttcatatgctgttgttcacgccttccctggatttctaacaggttttgctttatattttactttacatttttggtgttgatgggtttcttcgggaatattaattaaaaatagactttaaaatgtca

SEQ ID NO: 192164 - DNA, 4451 bp, Homo sapiens
  Payload ID: 17967
  Gene Name: transcription factor 3
  Uniprot ID: P15923
  ENST ID: ENST00000262965
  CDS Start-End: 70-2034
acgcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgatgc

SEQ ID NO: 192165 - DNA, 4289 bp, Homo sapiens
  Payload ID: 17967
  Gene Name: transcription factor 3
  ENST ID: ENST00000344749
  CDS Start-End: 70-1872
acgcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgatgc

SEQ ID NO: 192166 - DNA, 2779 bp, Homo sapiens
  Payload ID: 17967
  Gene Name: transcription factor 3
  Uniprot ID: P15923
  ENST ID: ENST00000395423
  CDS Start-End: 345-2321
cccgccgcaggaagatgaggcagcggcggcggctgcgggcgtagcgggccggagccgacgcggcggcgggcaccgcgggcaccgcgcacgccgctgccccaggggcgccccggccggccgcgcgcacgggccccgcgggacgggccacgcgggggtgggaggggcccgggccacgcgcgccgccgccgccgcccacgcgcgaccctcgggggcccggccgcgacgcacctttgtccgggggggggcccccccgcttcatgccgccgcccccccccacgcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccaggtgccaacccacccctcggcactccccaccctcaccccatcaggacgcacatgtgcacaggccacacgcacaccgcacccacactgggaggccgtcggcgggccccacgctcttcccccaacctcactgtctccctctggccccctcccggcgccctccccatagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctg

SEQ ID NO: 192167 - DNA, 3585 bp, Homo sapiens
  Payload ID: 17967
  Gene Name: transcription factor 3
  ENST ID: ENST00000453954
  CDS Start-End: 335-2374
gatgaggcagcggcggcggctgcgggcgtagcgggccggagccgacgcggcggcgggcaccgcgggcaccgcgcacgccgctgccccaggggcgccccggccggccgcgcgcacgggccccgcgggacgggccacgcgggggtgggaggggcccgggccacgcgcgccgccgccgccgcccacgcgcgaccctcgggggcccggccgcgacgcacctttgtccgggggggggcccccccgcttcatgccgccgcccccccccacgcgccgcgtgcccggccgcgcccagcagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggtgagtgcctggcctggtgcggtccctctgctgtgcacagatgtgcagacgtgggccttggcatggtcagtgcacgcacagcgccaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacga

SEQ ID NO: 192168 - DNA, 996 bp, Homo sapiens
  Payload ID: 17967
  Gene Name: transcription factor 3
  ENST ID: ENST00000592395
  CDS Start-End: 1-156
gcggccgccagcgagatcaagcgggaggagaaggaggacgaggagaacacgtcagcggctgaccactcggaggaggagaagaaggagctgaaggccccccgggcccggaccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacgatg

SEQ ID NO: 192169 - DNA, 1170 bp, Homo sapiens
  Payload ID: 17967
  Gene Name: transcription factor 3
  ENST ID: ENST00000585855
  CDS Start-End: 1-249
accctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaa

SEQ ID NO: 192170 - DNA, 1222 bp, Homo sapiens
  Payload ID: 17967
  Gene Name: transcription factor 3
  ENST ID: ENST00000585731
  CDS Start-End: 1-480
gcggccgccagcgagatcaagcgggaggagaaggaggacgaggagaacacgtcagcggctgaccactcggaggaggagaagaaggagctgaaggccccccgggcccggaccagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaaga

SEQ ID NO: 192171 - DNA, 1751 bp, Homo sapiens
  Payload ID: 17967
  Gene Name: transcription factor 3
  ENST ID: ENST00000592628
  CDS Start-End: 1-540
tctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacga

SEQ ID NO: 192172 - DNA, 986 bp, Homo sapiens
  Payload ID: 17967
  Gene Name: transcription factor 3
  ENST ID: ENST00000587235
  CDS Start-End: 346-986
tcccgccgcaggaagatgaggcagcggcggcggctgcgggcgtagcgggccggagccgacgcggcggcgggcaccgcgggcaccgcgcacgccgctgccccaggggcgccccggccggccgcgcgcacgggccccgcgggacgggccacgcgggggtgggaggggcccgggccacgcgcgccgccgccgccgcccacgcgcgaccctcgggggcccggccgcgacgcacctttgtccgggggggggcccccccgcttcatgccgccgcccccccccacgcgccgcgtgcccggccgcgcccagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgccccctt

SEQ ID NO: 192173 - DNA, 1313 bp, Homo sapiens
  Payload ID: 17967
  Gene Name: transcription factor 3
  ENST ID: ENST00000590684
  CDS Start-End: 1-662
ccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaa

SEQ ID NO: 192174 - DNA, 1149 bp, Homo sapiens
  Payload ID: 17967
  Gene Name: transcription factor 3
  ENST ID: ENST00000590436
  CDS Start-End: 1-944
gaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggtgagcgctgggcgagggtggagctgggcagtgggcggggacccggctccccctgatgcacccgtctccccacgcctgcaggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaaga

SEQ ID NO: 192175 - DNA, 631 bp, Homo sapiens
  Payload ID: 17967
  Gene Name: transcription factor 3
  ENST ID: ENST00000586318
  CDS Start-End: 347-631
acaaagaggggatttctctgcttctgaagttgggtctccctcgacctcggaggctcctccccacccccagcctcggaggtgtctcccgggctgcccccgtccccacctggggacccctggggaaagtcgagactggaggggcctggagtgcatttctttggaatggaaatttttctctgtacctttttctgggggtggaatgggtcttggcaggtggatcccccatcccccatcttagaatggagccccctgggaccacgcgggagcaccctggtcttgagacgctctccccgctcatggagggcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctggga

SEQ ID NO: 192176 - DNA, 288 bp, Homo sapiens
  Payload ID: 17967
  Gene Name: transcription factor 3
  ENST ID: ENST00000586410
  CDS Start-End: 1-288
atctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctggttggaggcagccaccccgaggacggcctcgcaggcagcaccagcctcatgcacaaccacgcggccctccccagccagccaggcaccctccctgacctgtctcggcctcccgactcctacagtgggctagggcga

SEQ ID NO: 192177 - DNA, 629 bp, Homo sapiens
  Payload ID: 17967
  Gene Name: transcription factor 3
  ENST ID: ENST00000587425
  CDS Start-End: 1-498
gccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtctgggtgggcagtggccccatagcctctggaactgtgcgttctgcatagaattcaaacgagattcacccagcgcgaggaggaagaaacagcagttcctgggaaccacaattatggggggtgggggg

SEQ ID NO: 192178 - DNA, 409 bp, Homo sapiens
  Payload ID: 17967
  Gene Name: transcription factor 3
  ENST ID: ENST00000586164
  CDS Start-End: 1-156
gcggccgccagcgagatcaagcgggaggagaaggaggacgaggagaacacgtcagcggctgaccactcggaggaggagaagaaggagctgaaggccccccgggcccggaccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagct

SEQ ID NO: 192179 - DNA, 2694 bp, Homo sapiens
  Payload ID: 17967
  Gene Name: transcription factor 3
  ENST ID: ENST00000593064
  CDS Start-End: 1-614
gcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacga

SEQ ID NO: 192180 - DNA, 2658 bp, Homo sapiens
  Payload ID: 17967
  Gene Name: transcription factor 3
  Uniprot ID: P15923
  ENST ID: ENST00000588136
  CDS Start-End: 498-2453
ggggaatcaccaaatttccctcggggcggggtaggatcgggctgttcctccctttcccgggggtagggggcctcagaggaagcccggggttggttggaaatgagagagttggagaaaggagaggttctggctgccctgcgtgcagtttaaacttggcaacttgatgccctggtgttccctgggggagttagggagtttatatttgcacaccctccccccatttttcagactccctgtggtctctggggaggactctgcagggacctagactctggaattccagcttccctgcgcctgctcccagggctccccgtgcccccagggctctgctggaactcagaccccagggcggttgagggttttttaggtggcttttagcactctgtgctttgaccactcacaactcttctcccctccctgtttctccctgtccatctgtccccacatccaccaagcagggtttccaggcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcagtacggacgaggtgctgtccctggaggagaaagacctgagggaccgggagaggcgcatggccaataacgcgcgggagcgggtgcgcgtgcgggatattaacgaggccttccgggagctggggcgcatgtgccagatgcacctcaagtcggacaaagcgcagaccaagctgctcatcctgcagcaggccgtgcaggtcatcctggggctggagcagcaggtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaaga

SEQ ID NO: 192181 - DNA, 4409 bp, Homo sapiens
  Payload ID: 17967
  Gene Name: transcription factor 3
  Uniprot ID: P15923
  ENST ID: ENST00000611869
  CDS Start-End: 31-1995
gcctgaggtgcccgccctggccccaggagaatgaaccagccgcagaggatggcgcctgtgggcacagacaaggagctcagtgacctcctggacttcagcatgatgttcccgctgcctgtcaccaacgggaagggccggcccgcctccctggccggggcgcagttcggaggttcaggtcttgaggaccggcccagctcaggctcctggggcagcggcgaccagagcagctcctcctttgaccccagccggaccttcagcgagggcacccacttcactgagtcgcacagcagcctctcttcatccacattcctgggaccgggactcggaggcaagagcggtgagcggggcgcctatgcctccttcgggagagacgcaggcgtgggcggcctgactcaggctggcttcctgtcaggcgagctggccctcaacagccccgggcccctgtccccttcgggcatgaaggggacctcccagtactacccctcctactccggcagctcccggcggagagcggcagacggcagcctagacacgcagcccaagaaggtccggaaggtcccgccgggtcttccatcctcggtgtacccacccagctcaggtgaggactacggcagggatgccaccgcctacccgtccgccaagacccccagcagcacctatcccgcccccttctacgtggcagatggcagcctgcacccctcagccgagctctggagtcccccgggccaggcgggcttcgggcccatgctgggtgggggctcatccccgctgcccctcccgcccggtagcggcccggtgggcagcagtggaagcagcagcacgtttggtggcctgcaccagcacgagcgtatgggctaccagctgcatggagcagaggtgaacggtgggctcccatctgcatcctccttctcctcagcccccggagccacgtacggcggcgtctccagccacacgccgcctgtcagcggggccgacagcctcctgggctcccgagggaccacagctggcagctccggggatgccctcggcaaagcactggcctcgatctactccccggatcactcaagcaataacttctcgtccagcccttctacccccgtgggctccccccagggcctggcaggaacgtcacagtggcctcgagcaggagcccccggtgccttatcgcccagctacgacgggggtctccacggcctgcagagtaagatagaagaccacctggacgaggccatccacgtgctccgcagccacgccgtgggcacagccggcgacatgcacacgctgctgcctggccacggggcgctggcctcaggtttcaccggccccatgtcactgggcgggcggcacgcaggcctggttggaggcagccaccccgaggacggcctcgcaggcagcaccagcctcatgcacaaccacgcggccctccccagccagccaggcaccctccctgacctgtctcggcctcccgactcctacagtgggctagggcgagcaggtgccacggcggccgccagcgagatcaagcgggaggagaaggaggacgaggagaacacgtcagcggctgaccactcggaggaggagaagaaggagctgaaggccccccgggcccggaccagcccagacgaggacgaggacgaccttctccccccagagcagaaggccgagcgggagaaggagcgccgggtggccaataacgcccgggagcggctgcgggtccgtgacatcaacgaggcctttaaggagctggggcgcatgtgccaactgcacctcaacagcgagaagccccagaccaaactgctcatcctgcaccaggctgtctcggtcatcctgaacttggagcagcaagtgcgagagcggaacctgaatcccaaagcagcctgtttgaaacggcgagaagaggaaaaggtgtcaggtgtggttggagacccccagatggtgctttcagctccccacccaggcctgagcgaagcccacaaccccgccgggcacatgtgaaaggtatgcctccgtgggacgagccacccgctttcagccctgtgctctggccccagaacggccactcgagaccccgggcttcatccacatccacacctcacacacctgttgtcagcatcgagccaacaccaacctgacaaggttcggagtgatgggggcggccaaggtgacactgggtccaggagctccctggggccctggcctaccactcactggcctcgctccccctgtccccgaatctcagccaccgtgtcactctgtgacctgtcccatggatcctgaaactgcatcttggccctgttgcctgggctgacaggagcattttttttttttccagtaaacaaaacctgaaagcaagcaacaaaacatacactttgtcagagaagaaaaaaatgccttaactataaaaagcggagaaatggaaacatatcactcaagggggatgctgtggaaacctggcttattcttctaaagccaccagcaaattgtgcctaagcgaaatattttttttaaggaaaataaaaacattagttacaagattttttttttcttaatgtagatgaaaattagcaaggatgctgcctttggtctctggtttttttaagctttttttgcatatgttttgtaagcaacaaatttttttgtataaaagtcccgtgtctctcgctatttctgctgctgttcctagactgagcattgcatttcttgatcaaccagatgattaaacgttgtattaaaaagaccccgtgtaaacctgagcccccccgtccccccccccccccggaagccactgcacacagacagaacggggacaggcggcgggtcttttgtttttttgatgttgggggttctcttggttttgtcatgtggaaagtgatgcgtgggcgttccctgatgaaggcaccttggggcttccctgccgcatcctctcccctcaggaaggggactgacctgggcttgggggaagggacgtcagcaaggtggctctgaccctcccaggtgactctgccaagcagctgtggcccccagggctaccctacacaacgccctccccaggcccccctaagctgctctcccttggaacctgcacagctctctgaaatggggcattttgttgggaccagtgacccctggcatggggaccacaccctggagcccggtgctggggacctcctggacaccctgtccttcactcctttgccccagggacccaggctcatgctctgaactctggctgagaggatgctgctcaggagccagcacaggacaccccccaccccaccccaccatgtccccattacaccagagggccatcgtgacgtagacaggatgccaggggcctggccagcctcccccaatgctggggagcatccctgggcctggggccacacctgctgccctccctctgtgtggtccaagggcaagagtggctggagccgggggactgtgctggtctgagccccacgaaggccttgggctgtgcgtccgaccctgctgcagaaccagcagggtgtcccctcgggcccatctgtgtcccatgtcccagcacccaggcctctctccaggtctccttttctggtcttttgccatgagggtaaccagctcttcccagctggctggggactgtcttgggtttaaaactgcaagtctcctaccctgggatcccatccagttccacacgaactagggcagtggtcactgtggcacccaggtgtgggcctggctagctgggggccttcatgtgcccttcatgcccctccctgcattgaggccttgtggacccctgggctggctgtgttcatccccgctgcaggtcgggcgtctccccccgtgccactcctgagactcccaccgttacccccaggagatcctggactgcctgactcccctccccagactggcttgggagcctgggccccatggtagatgcaagggaaacctcaaggccagctcaatgcctggtatctgcccccagtccaggccaggcggaggggaggggctgtccggctgcctctcccttctcggtggcttcccctacgccctgggagtttgatctcttaagggaacttgcctctccctcttgttttgctcctggccctgcccctaggtctgggtgggcagtggccccatagcctctggaactgtgcgttctgcatagaattcaaacgagattcacccagcgcgaggaggaagaaacagcagttcctgggaaccacaattatggggggtggggggtgtgatctgagtgcctcaagatggttttcaaaaaaatttttttaaagaaaataattgtatacgtgtcaacacagctggctggatgattgggactttaaaacgaccctctttcaggtggattcagagacctgtcctgtatataacagcactgtagcaataaacgtgacattttataacga

SEQ ID NO: 192182 - DNA, 3482 bp, Homo sapiens
  Payload ID: 17968
  Gene Name: transcription factor 4
  Uniprot ID: P15884
  ENST ID: ENST00000354452
  CDS Start-End: 216-2231
agagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaa

SEQ ID NO: 192183 - DNA, 8317 bp, Homo sapiens
  Payload ID: 17968
  Gene Name: transcription factor 4
  Uniprot ID: P15884
  ENST ID: ENST00000356073
  CDS Start-End: 613-2616
gtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagca

SEQ ID NO: 192184 - DNA, 2551 bp, Homo sapiens
  Payload ID: 17968
  Gene Name: transcription factor 4
  ENST ID: ENST00000398339
  CDS Start-End: 131-2452
agtagactcttccagctttgccatggtaacacttgtgcagcattccttttcgaacagtgcccattctcttgatgtctacagtatcacctttcttgtagattggcacttatgcggccaaaggaacaacaccatgttttctaaaaggctggagaaaataccacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagcaaatgttttgtaaacaccaatctaagaacattatctcttggacgggcatggtggctcacacctgtaatcccagcactttgggaggccaaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaaccccca

SEQ ID NO: 192185 - DNA, 2372 bp, Homo sapiens
  Payload ID: 17968
  Gene Name: transcription factor 4
  Uniprot ID: P15884
  ENST ID: ENST00000457482
  CDS Start-End: 485-2020
atttgtattctgctcaataatggaccctgttccacttttaccctaaggcagttgagtggaaattttagagaagaaaagggtgcctagaacaaaacaaaacaaaaaaaaaaaaaaaaaggaaaaaaaaaaagaaaagaaaaagaaaaaagtgaagactgcagaaatttgtaagaatcggcattattcgaggaactaataaaaacccctcggaaaagttgaatcgatctcgcgtatgcattaggatttcgagctccatcagggccgggctgccttccagctccgctgcgcaaagttgagcgtctgacagcagcgccgcggcctcccccgcccgccaggaatggtctcttcctgctttgcatattcaccacgcttggcccggccatatgggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaa

SEQ ID NO: 192186 - DNA, 2399 bp, Homo sapiens
  Payload ID: 17968
  Gene Name: transcription factor 4
  Uniprot ID: P15884
  ENST ID: ENST00000543082
  CDS Start-End: 176-2053
atcattaactcatgttctgtttccatggagcacaggagagtaacaaggaaggccccttaaaagaaaggccttttaaagtggaggtctcagttcacaaactttaaaagtttacgaagtagtattttagaattttaatcaccagatatattgggggaatttattacttcctattcatatggaagaggacagcagagatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttgg

SEQ ID NO: 192187 - DNA, 1996 bp, Homo sapiens
  Payload ID: 17968
  Gene Name: transcription factor 4
  Uniprot ID: P15884
  ENST ID: ENST00000537856
  CDS Start-End: 197-1810
agacacaaagatttcctctgctgagtaagcgtgaggccccttaacttgtgaaagcatcatccagaccgtgtgagtctgtctgtgtatgtgcagaacacagaccctcctttctccgtttgtggggaatacttccctcgggtgaaactgaagttaatttttttttttttccaaacacaagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaac

SEQ ID NO: 192188 - DNA, 2767 bp, Homo sapiens
  Payload ID: 17968
  Gene Name: transcription factor 4
  Uniprot ID: P15884
  ENST ID: ENST00000537578
  CDS Start-End: 541-2484
ggagcagccgcggccgcagctccttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagccc

SEQ ID NO: 192189 - DNA, 2264 bp, Homo sapiens
  Payload ID: 17968
  Gene Name: transcription factor 4
  Uniprot ID: P15884
  ENST ID: ENST00000544241
  CDS Start-End: 282-2084
gactcagaattttgaatagtttctttgctaaattcaccatctggagagcctgtgattgattagttttggcctcactattaagtgtcaatataatcaatgggaattactaggctagggtcattacatagataatttgcctgctgtgtaaataaaaatgaaattgtttaaattttgtgcaagagaaagtgaaaataaggagttacgatttgtttgttagagaaagtggaggccattggaatgacagtttttggaagtgtggagcagtttggctaagaataggaatgaaggatatttttttccagtttatcatagccagagtgaggaagtgttattccctctcttgcttgcatacattgccagtagtgcctactttacgtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacag

SEQ ID NO: 192190 - DNA, 2572 bp, Homo sapiens
  Payload ID: 17968
  Gene Name: transcription factor 4
  Uniprot ID: P15884
  ENST ID: ENST00000540999
  CDS Start-End: 296-2227
cttttggagaaatggctttcggaagttttgccaggaaacgtagccctaggcaggcagctttgcagccccctttctgcttgttgcactttctccattcgttcctttgctttttgcaggctctgactcagggaaggtgtgcattatccactagatacgtcgaagaagagggaaaccaattagggtcgaaataaatgctggagagagagggagtgaaagagagagtgagagtgagagagagagagagtcttgcttcaaattgctctcctgttagagacgaaatgagaatttagtgcagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttg

SEQ ID NO: 192191 - DNA, 568 bp, Homo sapiens
  Payload ID: 17968
  Gene Name: transcription factor 4
  ENST ID: ENST00000564343
  CDS Start-End: 164-568
gatgatgcttgtgataatgcagcaaaaagtaatgtctaaatgtaagatattattttgagatgagaacaccgaatggggatggaagacaggaatcttcaccatgtgtgaatgtacaggaaacaaccaataaatgccttaattcttgttctgtaaaaacttacatatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggagg

SEQ ID NO: 192192 - DNA, 585 bp, Homo sapiens
  Payload ID: 17968
  Gene Name: transcription factor 4
  ENST ID: ENST00000569357
  CDS Start-End: 1-373
ttctaaaaggctggagaaaataccacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagcaaatgttttgtaaacaccaatctaagaacattatctcttggacgggcatggtggctcacacctgtaatcccagcactttgggaggccaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagagtctcc

SEQ ID NO: 192193 - DNA, 1948 bp, Homo sapiens
  Payload ID: 17968
  Gene Name: transcription factor 4
  Uniprot ID: P15884
  ENST ID: ENST00000567880
  CDS Start-End: 1-1824
atgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctga

SEQ ID NO: 192194 - DNA, 314 bp, Homo sapiens
  Payload ID: 17968
  Gene Name: transcription factor 4
  ENST ID: ENST00000565393
  CDS Start-End: 1-184
gaacattatctcttggacgggcatggtggctcacacctgtaatcccagcactttgggaggccaagatggagtctcattctgtcatccagaccggagtgcagtggcaccatctcagctcactgcaacctccacctcccaggttcaagctatcctcctgcctcagcctcctgagtacccgggataggcgtttgtgtgattttgctaaaatgcatcaccaacagcgaatggctgccttagggacggacaaagagctgagtgatttactggatttcagtgcgatgttttcacctcctgtgagcagtgggaaaaatgga

SEQ ID NO: 192195 - DNA, 805 bp, Homo sapiens
  Payload ID: 17968
  Gene Name: transcription factor 4
  ENST ID: ENST00000565908
  CDS Start-End: 177-805
agggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaa

SEQ ID NO: 192196 - DNA, 1872 bp, Homo sapiens
  Payload ID: 17968
  Gene Name: transcription factor 4
  Uniprot ID: P15884
  ENST ID: ENST00000570177
  CDS Start-End: 208-1821
agtttactcccttggcccagccaccaattcagtcatattcggcatctgaaagatttgttgcattgaggtgaacagtgcttggttaagagctcctgccggagtgcagttcatggcagtttgtttggaaagaattctgcaggaaagaaatttacagccattccagcgcaacggaaacatctttggaatcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttcctta

SEQ ID NO: 192197 - DNA, 597 bp, Homo sapiens
  Payload ID: 17968
  Gene Name: transcription factor 4
  ENST ID: ENST00000562847
  CDS Start-End: 429-597
attatccactagatacgtcgaagaagagggaaaccaattagggtcgaaataaatgctggagagagagggagtgaaagagagagtgagagtgagagagagagagagtcttgcttcaaattgctctcctgttagagacgaaatgagaatttagtgcagatgttttcacctcctgtgagcagtgggaaaaatggaccaacttctttggcaagtggacattttactggctcaaactgaacttgctgccattgaaagtcaatgaggaagcaagtagatctggaatcctatgaccatgagagaagcctgctttagggtgaagttgacatggaagtgtcagagatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacc

SEQ ID NO: 192198 - DNA, 602 bp, Homo sapiens
  Payload ID: 17968
  Gene Name: transcription factor 4
  ENST ID: ENST00000562607
  CDS Start-End: 112-602
tgcaaaccaaagagaaaggcaaaatctcagtatcttgggcttcaagtctaaatagcagatcacagctgaaatgattccccactgtgtgacaagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctc

SEQ ID NO: 192199 - DNA, 2398 bp, Homo sapiens
  Payload ID: 17968
  Gene Name: transcription factor 4
  Uniprot ID: P15884
  ENST ID: ENST00000568673
  CDS Start-End: 99-2042
gagagagagggagtgaaagagagagtgagagtgagagagagagagagtcttgcttcaaattgctctcctgttagagacgaaatgagaatttagtgcagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaa

SEQ ID NO: 192200 - DNA, 550 bp, Homo sapiens
  Payload ID: 17968
  Gene Name: transcription factor 4
  ENST ID: ENST00000568147
  CDS Start-End: 55-550
gcattatccactagatacgtcgaagaagagggaaaccaattagggtcgaaataaatgctggagagagagggagtgaaagagagagtgagaatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctc

SEQ ID NO: 192201 - DNA, 2184 bp, Homo sapiens
  Payload ID: 17968
  Gene Name: transcription factor 4
  Uniprot ID: P15884
  ENST ID: ENST00000561992
  CDS Start-End: 400-2013
ataggaaagtacttttatttgtgacccaagtatgagaatttctggcaaactttttttttaatattaaaaaaaaccccccaaaccctccaccttttcccttctttccttttccctttcaagactatttaaatgtacatagtaaaacatgttaggacagccaagccccagcatgttgtgttctgtcctctggctggcagattcacgccacaacagtttattcatccacatgctttttggcgactcttcatcacgtatttgggcttagatcttctggtgcctccctcggcgtgctacccataaggtcgaaagaaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatc

SEQ ID NO: 192202 - DNA, 1915 bp, Homo sapiens
  Payload ID: 17968
  Gene Name: transcription factor 4
  Uniprot ID: P15884
  ENST ID: ENST00000564228
  CDS Start-End: 1-1791
atgaaggatatttttttccagtttatcatagccagagtgaggaagtgttattccctctcttgcttgcatacattgccagtagtgcctactttacgtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctga

SEQ ID NO: 192203 - DNA, 561 bp, Homo sapiens
  Payload ID: 17968
  Gene Name: transcription factor 4
  ENST ID: ENST00000569012
  CDS Start-End: 74-561
aagagaggtggatggattggcatgtgatggctgaatttctgggccttgggagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcac

SEQ ID NO: 192204 - DNA, 2628 bp, Homo sapiens
  Payload ID: 17968
  Gene Name: transcription factor 4
  ENST ID: ENST00000568740
  CDS Start-End: 511-2439
tataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaa

SEQ ID NO: 192205 - DNA, 2119 bp, Homo sapiens
  Payload ID: 17968
  Gene Name: transcription factor 4
  Uniprot ID: P15884
  ENST ID: ENST00000566286
  CDS Start-End: 1-1995
atgcaacgggcaaaaactgaactgttcaggcttcagattgtaactgacgatctgaggaaaaatgagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctga

SEQ ID NO: 192206 - DNA, 598 bp, Homo sapiens
  Payload ID: 17968
  Gene Name: transcription factor 4
  ENST ID: ENST00000562543
  CDS Start-End: 181-598
gatgcttgtgataatgcagcaaaaagtaatgtctaaatgtaagatattattttgagatgagaacaccgaatggggatggaagacaggaatcttcaccatgtgtgaatgtacaggaaacaaccaataaatgccttaattcttgttctgtaaaaacttacatgtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaacccttt

SEQ ID NO: 192207 - DNA, 3163 bp, Homo sapiens
  Payload ID: 17968
  Gene Name: transcription factor 4
  Uniprot ID: P15884
  ENST ID: ENST00000570287
  CDS Start-End: 249-1772
attaggatttcgagctccatcagggccgggctgccttccagctccgctgcgcaaagttgagcgtctgacagcagcgccgcggcctcccccgcccgccaggaatggtctcttcctgctttgcatattcaccacgcttggcccggccatatgggaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctg

SEQ ID NO: 192208 - DNA, 2357 bp, Homo sapiens
  Payload ID: 17968
  Gene Name: transcription factor 4
  Uniprot ID: P15884
  ENST ID: ENST00000565018
  CDS Start-End: 482-2233
gattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctga

SEQ ID NO: 192209 - DNA, 2128 bp, Homo sapiens
  Payload ID: 17968
  Gene Name: transcription factor 4
  Uniprot ID: P15884
  ENST ID: ENST00000566279
  CDS Start-End: 169-2004
gtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctga

SEQ ID NO: 192210 - DNA, 1084 bp, Homo sapiens
  Payload ID: 17968
  Gene Name: transcription factor 4
  ENST ID: ENST00000562030
  CDS Start-End: 547-1084
atggctgaatttctgggccttgggaggttcgttttgaggcattaatgtccaggaaaattcttttgtatatagcactatgactgcatatgcttttcttaaaaagccttcgtaatgtagccgtggagtgtggagattccttcattcttaatttgtgcttcatggttgtgagtcttgcaagagtctactatctctgtgcttagcgtggtcgcagcaatctccataaacagtgtgattacttagggataaataaaagtgaaattttggaaatttgctgacagagggaaaatagggactgaagatgaaaaatgtacagagtatgaatttctgctttctgtgaaatttgagaatagaacagaccatagtgtgtcttccagtgaatcagtttctcttgtgccgtattgttatttgaatccctgtctacaacatcagctatgcaaaccaaagagaaaggcaaaatctcagtatcttgggcttcaagtctaaatagcagatcacagctgaaatgattccccactgtgtgacaagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaata

SEQ ID NO: 192211 - DNA, 401 bp, Homo sapiens
  Payload ID: 17968
  Gene Name: transcription factor 4
  ENST ID: ENST00000562638
  CDS Start-End: 46-401
ttgtgaaagcatcatccagaccgtcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattcc

SEQ ID NO: 192212 - DNA, 969 bp, Homo sapiens
  Payload ID: 17968
  Gene Name: transcription factor 4
  ENST ID: ENST00000566514
  CDS Start-End: 107-969
gtcttgcttcaaattgctctcctgttagagacgaaatgagaatttagtgcaggtggcacttttatttttatttgggttcacatatgacaggcaaatcctatacgagatggaaatggacattgccacgtttatggccaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaa

SEQ ID NO: 192213 - DNA, 555 bp, Homo sapiens
  Payload ID: 17968
  Gene Name: transcription factor 4
  ENST ID: ENST00000565124
  CDS Start-End: 52-555
agtatcacctttcttgtagattggcacttatgcggccaaaggaacaacaccatgttttctaaaaggctggagaaaataccacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagatggagtctcattctgtcatccagaccggagtgcagtggcaccatctcagctcactgcaacctccacctcccaggttcaagctatcctcctgcctcagcctcctgagtacccgggataggcgtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctca

SEQ ID NO: 192214 - DNA, 897 bp, Homo sapiens
  Payload ID: 17968
  Gene Name: transcription factor 4
  ENST ID: ENST00000563824
  CDS Start-End: 422-897
ggcaaatcctatacgagatggaaatggacattgccacgtttatggccaaggttttcaatataaaacaaaacaacttttttcttctccttggtgaaactagtgtttttctagagaggctgctggcctccaacctgaatcttgataacattatggggactgtgtttgttccaaatgtagcagtagtactgcttggccatctaatgaacctgaggaaaaagaaagaacagagtgataatgggggctggggtgggatctgtaatgttgtttctcttttagttttaagttggatggtgatgtattttactaaataaacccttagcataaactctaagctgtttggtaacagtatgaaagatctttgaggagctctgaaggcacaagtgtcttcttttcaactgtaatatttctttgtttcttttagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttc

SEQ ID NO: 192215 - DNA, 653 bp, Homo sapiens
  Payload ID: 17968
  Gene Name: transcription factor 4
  ENST ID: ENST00000566777
  CDS Start-End: 251-653
agtaaaacatgttaggacagccaagccccagcatgttgtgttctgtcctctggctggcagattcacgccacaacagtttattcatccacatgctttttggcgactcttcatcacgtatttgggcttagatcttctggtgcctccctcggcgtgctacccataaggtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagct

SEQ ID NO: 192216 - DNA, 2696 bp, Homo sapiens
  Payload ID: 17968
  Gene Name: transcription factor 4
  ENST ID: ENST00000564403
  CDS Start-End: 564-2597
ggaggagcagccgcggccgcagctccttctctttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcattggttctttctcctcaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaaccccca

SEQ ID NO: 192217 - DNA, 870 bp, Homo sapiens
  Payload ID: 17968
  Gene Name: transcription factor 4
  ENST ID: ENST00000568169
  CDS Start-End: 30-870
gccagaattggcacggacgccgaggaggcatgagagcgagcaagggctctgagggctgccagcatgctgtcacctctcaattggttacaggagcaggaggggaccaaacagagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtc

SEQ ID NO: 192218 - DNA, 3590 bp, Homo sapiens
  Payload ID: 17968
  Gene Name: transcription factor 4
  Uniprot ID: P15884
  ENST ID: ENST00000564999
  CDS Start-End: 198-2201
gtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtc

SEQ ID NO: 192219 - DNA, 570 bp, Homo sapiens
  Payload ID: 17968
  Gene Name: transcription factor 4
  ENST ID: ENST00000563888
  CDS Start-End: 133-570
ttttggagaaatggctttcggaagttttgccaggaaacgtagccctaggcaggcagctttgcagccccctttctgcttgttgcactttctccattcgttcctttgctttttgcaggctctgactcagggaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaag

SEQ ID NO: 192220 - DNA, 1823 bp, Homo sapiens
  Payload ID: 17968
  Gene Name: transcription factor 4
  Uniprot ID: P15884
  ENST ID: ENST00000561831
  CDS Start-End: 143-1666
gagtttcatatatccagcatgaagttccctctctccctcccattatgaattctgggctgtggtcctgcttgctccttgtgtgtcagattgaagttctgatgctgtcagccatgtctgaccaatcagcaaacaacaccacaggatgaaatttaaacaatgcagatgctcagatacagggctatgttgcctggaccacgaagggaaagcagaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcag

SEQ ID NO: 192221 - DNA, 583 bp, Homo sapiens
  Payload ID: 17968
  Gene Name: transcription factor 4
  ENST ID: ENST00000568186
  CDS Start-End: 226-583
ctctcttgcttgcatacattgccagtagtgcctactttacgtatgtaaacatcggggaagagcagtagatgtctgttacctggaggagatttttttttaaggaaaaacacaatttacacttttttgtcgtttctcttggcaggtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccac

SEQ ID NO: 192222 - DNA, 362 bp, Homo sapiens
  Payload ID: 17968
  Gene Name: transcription factor 4
  ENST ID: ENST00000590810
  CDS Start-End: 168-362
cgggctagatagcctgggcgacaagcctctgagtgctgtgtctctggtgtaaagctctcagttcctgcagaagaccgtgttcctgtgggtctggtttctgagggtcaaggcggaggtcattagagttttggggagaagaaagttgacaacatccttcctttctgcagatggtcatggcagagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttca

SEQ ID NO: 192223 - DNA, 661 bp, Homo sapiens
  Payload ID: 17968
  Gene Name: transcription factor 4
  ENST ID: ENST00000570146
  CDS Start-End: 1-500
ctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcaggtagtgtatttcaaatcccatttcatcatataacagtttataagaatgattccccccttgtacttcctgattttgtaggtggaaactcacttccccccaaatcccaaagctttaacattcctataacagacaaatacaaagggtgggagagacaaattaccagataacagtatagtcgtttacatccaaaccttttcttaaaaattagattatctttttaaaatatacaggcatatggaaaatgtatttcttacacttttcttagctctgcagaagacacccaacggcagaataatgtattccaataaaacgtctcagatgaaaaaaa

SEQ ID NO: 192224 - DNA, 8140 bp, Homo sapiens
  Payload ID: 17968
  Gene Name: transcription factor 4
  Uniprot ID: P15884
  ENST ID: ENST00000616053
  CDS Start-End: 685-2436
gtgtgtggatgtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtgctcgatgaattttcgtttgtattttttggcgaggcgggggaggtgttgagattttttttttttcccctcggggtgggtgcgagggggatgcatcctagcctgcccgacccggagcaagtcgcgtctccccgccggagcccccccacccatttctttgctgaacttgcaattccgtgcgcctcggcgtgtttccccctccccccttccctccgtcccctcccctccccggagaagagagttggtgttaagagtcagggatcttggctgtgtgtctgcggatctgtagtggcggcggcggcggcggcggcggggaggcagcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcattt

SEQ ID NO: 192225 - DNA, 826 bp, Homo sapiens
  Payload ID: 17968
  Gene Name: transcription factor 4
  ENST ID: ENST00000628636
  CDS Start-End: 153-826
gtatttgggcttagatcttctggtgcctccctcggcgtgctacccataaggtcgaaagaaaagcaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctct

SEQ ID NO: 192226 - DNA, 1701 bp, Homo sapiens
  Payload ID: 17968
  Gene Name: transcription factor 4
  Uniprot ID: P15884
  ENST ID: ENST00000626584
  CDS Start-End: 346-1701
tagtaaaacatgttaggacagccaagccccagcatgttgtgttctgtcctctggctggcagattcacgccacaacagtttattcatccacatgctttttggcgactcttcatcacgtatttgggcttagatcttctggtgcctccctcggcgtgctacccataaggtcgaaagaaaagcaagtaaaacagaaaggggctcatactcatcttatgggagagaatcaaacttacagggttgccaccaggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaa

SEQ ID NO: 192227 - DNA, 579 bp, Homo sapiens
  Payload ID: 17968
  Gene Name: transcription factor 4
  ENST ID: ENST00000626425
  CDS Start-End: 43-579
aaattgctctcctgttagagacgaaatgagaatttagtgcagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctcc

SEQ ID NO: 192228 - DNA, 807 bp, Homo sapiens
  Payload ID: 17968
  Gene Name: transcription factor 4
  ENST ID: ENST00000629343
  CDS Start-End: 99-807
acatgctttttggcgactcttcatcacgtatttgggcttagatcttctggtgcctccctcggcgtgctacccataagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggag

SEQ ID NO: 192229 - DNA, 737 bp, Homo sapiens
  Payload ID: 17968
  Gene Name: transcription factor 4
  ENST ID: ENST00000630319
  CDS Start-End: 130-737
gatgtattttactaaataaacccttagcataaactctaagctgtttggtaacagtatgaaagatctttgaggagctctgaaggcacaagtgtcttcttttcaactgtaatatttctttgtttcttttagatgttttcacctcctgtgagcagtgggaaaaatggaccaacttctttggcaagtggacattttactggctcaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgat

SEQ ID NO: 192230 - DNA, 635 bp, Homo sapiens
  Payload ID: 17968
  Gene Name: transcription factor 4
  ENST ID: ENST00000630268
  CDS Start-End: 171-635
atattcggcatctgaaagatttgttgcattgaggtgaacagtgcttggttaagagctcctgccggagtgcagttcatggcagtttgtttggaaagaattctgcaggaaagaaatttacagccattccagcgcaacggaaacatctttggaatagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgt

SEQ ID NO: 192231 - DNA, 3789 bp, Homo sapiens
  Payload ID: 17968
  Gene Name: transcription factor 4
  Uniprot ID: P15884
  ENST ID: ENST00000629387
  CDS Start-End: 532-2547
ttataagcccgcagttcccggatgtgaatggattacaatgtatctttcagggaaacctattattatcaatgtgactccacgggggagtccatggtgatgatgatgaggaggaggatgatgatgatgagacacctctaaacttggaacaagtttaagactttatgagagaagaaaaaaaatcaccaacaagaattgtttgaggaaaaattataactatcctgtgttcatttttttttttataaacaataagaaaaagttgttggatttttttttaatgatttcttttttgggggagggaattttgttgcagttttatggtggaaaatgcaaaaaccagagccaggtgcataatcttgtaatctgtggatatccctggagcaggactgagtaccagttaaaatactttttggggatacacatgtgagatactaagtacttgcagaagatttttgtctctctttttaaagtctctttccttggaatattgtgagaatatttgtggccatttaaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaa

SEQ ID NO: 192232 - DNA, 1277 bp, Homo sapiens
  Payload ID: 17968
  Gene Name: transcription factor 4
  ENST ID: ENST00000628078
  CDS Start-End: 656-1277
cctgtttcccaaatgtaaattccatcatcatcttgatcatgatggggttcactcctgggaaagggagtttttaaaaaagagagagagagagagactcagaattttgaatagtttctttgctaaattcaccatctggagagcctgtgattgattagttttggcctcactattaagtgtcaatataatcaatgggaattactaggctagggtcattacatagataatttgcctgctgtgtaaataaaaatgaaattgtttaaattttgtgcaagagaaagtgaaaataaggagttacgatttgtttgttagagaaagtggaggccattggaatgacagtttttggaagtgtggagcagtttggctaagaataggaatgaaggatatttttttccagtttatcatagccagagtgaggaagtgttattccctctcttgcttgcatacattgccagtagtgcctactttacgtatgtaaacatcggggaagagcagtagatgtctgttacctggaggagatttttttttaaggaaaaacacaatttacacttttttgtcgtttctcttggcaggtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacacta

SEQ ID NO: 192233 - DNA, 735 bp, Homo sapiens
  Payload ID: 17968
  Gene Name: transcription factor 4
  ENST ID: ENST00000630828
  CDS Start-End: 51-735
attggaatgacagtttttggaagtgtggagcagtttggctaagaataggaatgaaggatatttttttccagtttatcatagccagagtgaggaagtgttattccctctcttgcttgcatacattgccagtagtgcctactttacgtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctc

SEQ ID NO: 192234 - DNA, 721 bp, Homo sapiens
  Payload ID: 17968
  Gene Name: transcription factor 4
  ENST ID: ENST00000628689
  CDS Start-End: 98-340
gaaaatgcaactgaaggaattgttgtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctgg

SEQ ID NO: 192235 - DNA, 501 bp, Homo sapiens
  Payload ID: 17968
  Gene Name: transcription factor 4
  ENST ID: ENST00000630224
  CDS Start-End: 61-306
gatgtctacagtatcacctttcttgtagattggcacttatgcggccaaaggaacaacaccatgttttctaaaaggctggagaaaataccacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactc

SEQ ID NO: 192236 - DNA, 601 bp, Homo sapiens
  Payload ID: 17968
  Gene Name: transcription factor 4
  ENST ID: ENST00000627784
  CDS Start-End: 134-601
agcaggcgcgggagcgggcgcaggagcaggcggcggcggtggcggcggcggttagacatgaacgccgcctcggcgccggcggtgcacggagagccccttctcgcgcgcgggcggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccga

SEQ ID NO: 192237 - DNA, 882 bp, Homo sapiens
  Payload ID: 17968
  Gene Name: transcription factor 4
  ENST ID: ENST00000627685
  CDS Start-End: 271-882
tggggctctttcatgctgctgctgctgctgctgctgctgctgctgctgctgctgctgctgctgctgctgctgctgctgctgctgctgctcctcctcctcctcctccttctcctcctcctcctcctcttctagaccttcttttggagaaatggctttcggaagttttgccaggaaacgtagccctaggcaggcagctttgcagccccctttctgcttgttgcactttctccattcgttcctttgctttttgcaggctctgactcagggaagatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagc

SEQ ID NO: 192238 - DNA, 1018 bp, Homo sapiens
  Payload ID: 17968
  Gene Name: transcription factor 4
  ENST ID: ENST00000630720
  CDS Start-End: 74-1018
gtgaaaaaagggacagcgagtttgaaataaaagttgttagagtggtactgaggagaaaaaagaatccgagaccatgtactgcgcatacacaatcccgggcatgggcggcaactctttgatgtactactataatgggaaagcggtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctatccatcacactcctcagcagacatcaattccagtcttcctccgatgtccactttccatcgtagtggtacaaaccattacagcacctcttcctgtacgcctcctgccaacgggacagacagtataatggcaaatagaggaagcggggcagccggcagctcccagactggagatgctctggggaaagcacttgcttcgatctattctccagatcacactaacaacagcttttcatcaaacccttcaactcctgttggctctcctccatctctctcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacag

SEQ ID NO: 192239 - DNA, 606 bp, Homo sapiens
  Payload ID: 17968
  Gene Name: transcription factor 4
  ENST ID: ENST00000625925
  CDS Start-End: 202-606
agattcacgccacaacagtttattcatccacatgctttttggcgactcttcatcacgtatttgggcttagatcttctggtgcctccctcggcgtgctacccataaggtcgaaagaaaagtaaaacagaaaggggctcatactcatcttatgggagagaatcaaacttacagggttgccaccagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatccacatgaacgtttgagctat

SEQ ID NO: 192240 - DNA, 833 bp, Homo sapiens
  Payload ID: 17968
  Gene Name: transcription factor 4
  ENST ID: ENST00000626595
  CDS Start-End: 171-833
gtgtgagtgagagggaacgagagtaagagaaagaaagaagtgaggggatgtaaactcgaataaatttcaaagtgcctccgagggatgcaacgggcaaaaactgaactgttcaggcttcagattgtaactgacgatctgaggaaaaatgaggtttgtgtgattttgctaaaatgcatcaccaacagcgaatggctgccttagggacggacaaagagctgagtgatttactggatttcagtgcgatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtcaattccagaatacaaagtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccat

SEQ ID NO: 192241 - DNA, 831 bp, Homo sapiens
  Payload ID: 17968
  Gene Name: transcription factor 4
  ENST ID: ENST00000630712
  CDS Start-End: 446-831
agattctcttttttttaataataggaaagtacttttatttgtgacccaagtatgagaatttctggcaaactttttttttaatattaaaaaaaaccccccaaaccctccaccttttcccttctttccttttccctttcaagactatttaaatgtacatagtaaaacatgttaggacagccaagccccagcatgttgtgttctgtcctctggctggcagattcacgccacaacagtttattcatccacatgctttttggcgactcttcatcacgtatttgggcttagatcttctggtgcctccctcggcgtgctacccataaggtcgaaagaaaagcaagtattcgatttctctattcagggtaaaacagaaaggggctcatactcatcttatgggagagaatcaaacttacagggttgccaccagcagagtctccttggaggtgacatggatatgggcaacccaggaaccctttcgcccaccaaacctggttcccagtactatcagtattctagcaataatccccgaaggaggcctcttcacagtagtgccatggaggtacagacaaagaaagttcgaaaagttcctccaggtttgccatcttcagtctatgctccatcagcaagcactgccgactacaatagggactcgccaggctatccttcctccaaaccagcaaccagcactttccctagctccttcttcatgcaagatggccatcacagcagtgacccttggagctcctccagtgggatgaatcagcctggctatgcaggaatgttgggcaactcttctcatattccacagtccagcagctactgtagcctgcatcc

SEQ ID NO: 192242 - DNA, 622 bp, Homo sapiens
  Payload ID: 17968
  Gene Name: transcription factor 4
  ENST ID: ENST00000626631
  CDS Start-End: 1-246
ctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggcaagtttgttttcagccatttctgagatcgatcattcaaaactctcatcagtgtatcagccataaaagtgaatttcacccaaattgacagatattttctttcatggaaaaagaattttttttaaaaaaagcatactttttctgttacaaatatattaatgaattttttctctcttttttcctttctcaggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaac

SEQ ID NO: 192243 - DNA, 699 bp, Homo sapiens
  Payload ID: 17968
  Gene Name: transcription factor 4
  ENST ID: ENST00000627320
  CDS Start-End: 76-480
agtgcccattctcttgatgtctacagtatcacctttcttgtagattggcacttatgcggccaaaggaacaacaccatgttttctaaaaggctggagaaaataccacaggtgcctctcctctttcccttcatcttcatcattttgacaaattactcaaagatggagggtgcagttgaaagccagccatcattttttaaaacttctcaggacattgtaacatgcacttgggttgagaactgctactcgagcttctccaggaggcccttggagcaaatgttttgtaaacaccaatctaagaacattatctcttggacgggcatggtggctcacacctgtaatcccagcactttgggaggccaagatggagtctcattctgtcatccagaccggagtgcagtggcaccatctcagctcactgcaacctccacctcccaggttcaagctatcctcctgcctcagcctcctgagtacccgggataggcatgttttcacctcctgtgagcagtgggaaaaatggaccaacttctttggcaagtggacattttactggctcaaatgtagaagacagaagtagctcagggtcctgggggaatggaggacatccaagcccgtccaggaactatggagatgggactccctatgaccacatgaccagcagggaccttgggtcacatgacaatctctctccaccttttgtca

SEQ ID NO: 192244 - DNA, 3045 bp, Homo sapiens
  Payload ID: 17969
  Gene Name: transcription factor 7 (T-cell specific, HMG-box)
  Uniprot ID: P36402
  ENST ID: ENST00000342854
  CDS Start-End: 197-1351
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaa

SEQ ID NO: 192245 - DNA, 2929 bp, Homo sapiens
  Payload ID: 17969
  Gene Name: transcription factor 7 (T-cell specific, HMG-box)
  Uniprot ID: P36402
  ENST ID: ENST00000378560
  CDS Start-End: 98-904
atccccgcctcccctcctgcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctga

SEQ ID NO: 192246 - DNA, 2815 bp, Homo sapiens
  Payload ID: 17969
  Gene Name: transcription factor 7 (T-cell specific, HMG-box)
  Uniprot ID: P36402
  ENST ID: ENST00000395023
  CDS Start-End: 80-889
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctga

SEQ ID NO: 192247 - DNA, 3330 bp, Homo sapiens
  Payload ID: 17969
  Gene Name: transcription factor 7 (T-cell specific, HMG-box)
  ENST ID: ENST00000395029
  CDS Start-End: 196-1641
ccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactggg

SEQ ID NO: 192248 - DNA, 796 bp, Homo sapiens
  Payload ID: 17969
  Gene Name: transcription factor 7 (T-cell specific, HMG-box)
  ENST ID: ENST00000517741
  CDS Start-End: 280-582
gacagaattggccaaggtttcttggttggagggcggggggtgggaggtcaagtaggggccacctcggggaggcctgccctccaggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtggtttttccaggcctgaaggccccggagtgcaccagcggcatgtacaaagagaccgtctactccgccttcaatctgctcatgcattacccacccccctcgggagcagggcagcacccccagccgcagcccccgctggtaagtggaccccgcagccagtgccgccctgtgcttgcagcctccttgaccagcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgccccc

SEQ ID NO: 192249 - DNA, 539 bp, Homo sapiens
  Payload ID: 17969
  Gene Name: transcription factor 7 (T-cell specific, HMG-box)
  ENST ID: ENST00000521639
  CDS Start-End: 98-539
acttccggtgccctgacctttataggagtaaacagacccccgccatccccgcctcccctcctgcccaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaagg

SEQ ID NO: 192250 - DNA, 557 bp, Homo sapiens
  Payload ID: 17969
  Gene Name: transcription factor 7 (T-cell specific, HMG-box)
  ENST ID: ENST00000522375
  CDS Start-End: 98-557
atccccgcctcccctcctgcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgc

SEQ ID NO: 192251 - DNA, 570 bp, Homo sapiens
  Payload ID: 17969
  Gene Name: transcription factor 7 (T-cell specific, HMG-box)
  ENST ID: ENST00000517799
  CDS Start-End: 1-444
ggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagatgggatccctgcctgtaccatcctgagcccttaatctgaaaaagcaaggtgacaacaacacagaaccatctggttgccaggaggaaaaagaaatgcattcggtacttacccggagaaggccgctgccccagccccgttccttccgatgacagtgctctag

SEQ ID NO: 192252 - DNA, 799 bp, Homo sapiens
  Payload ID: 17969
  Gene Name: transcription factor 7 (T-cell specific, HMG-box)
  ENST ID: ENST00000517855
  CDS Start-End: 1-613
gttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcgaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtggg

SEQ ID NO: 192253 - DNA, 1408 bp, Homo sapiens
  Payload ID: 17969
  Gene Name: transcription factor 7 (T-cell specific, HMG-box)
  Uniprot ID: P36402
  ENST ID: ENST00000520958
  CDS Start-End: 329-1138
cccgcctcccctcctgcccaggtgactgactaatccgccgccttcaggagacagaattggccaaggtttcttggttggagggcggggggtgggaggtcaagtaggggccacctcggggaggcctgccctccaggtccttcccctaaaacttggcactgccgatactcccagcccgttccttcccaagtcaggaacttgcaggggaccccttggcaattctttttctctcaagagcagacagccttcagtcccagccgctgccagggctggtgtgtctgacccagctgtggtttttccaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacag

SEQ ID NO: 192254 - DNA, 547 bp, Homo sapiens
  Payload ID: 17969
  Gene Name: transcription factor 7 (T-cell specific, HMG-box)
  ENST ID: ENST00000519037
  CDS Start-End: 119-547
agacagaggcccagggtctacgaaggatgtgcggtgagactggagaagaaggtcccagcctgtgaccttggtgctggggcagcgctggttccagagcctgggagaagctgatgggcgcatgcagcatgttggcatcatgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatg

SEQ ID NO: 192255 - DNA, 651 bp, Homo sapiens
  Payload ID: 17969
  Gene Name: transcription factor 7 (T-cell specific, HMG-box)
  ENST ID: ENST00000520652
  CDS Start-End: 1-216
tactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaaggtacaagcctgggatggggaggggcccagtgaaaccagagcctaagggccaagaccccagcttctgagaccagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagat

SEQ ID NO: 192256 - DNA, 459 bp, Homo sapiens
  Payload ID: 17969
  Gene Name: transcription factor 7 (T-cell specific, HMG-box)
  ENST ID: ENST00000520699
  CDS Start-End: 1-317
tcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaaaatttaaagttgacagatatcagaaggtcgcaagaactacagatgtggaagcagacactgttatgagcaactacattcctcccatagaatgctgctcaatactggcacacagaccagaggtagccagcagtacacaagactgcaaggcaacaagtacattatcaatgaattagccatctatcactcaaactatgtcccgcattggaag

SEQ ID NO: 192257 - DNA, 600 bp, Homo sapiens
  Payload ID: 17969
  Gene Name: transcription factor 7 (T-cell specific, HMG-box)
  ENST ID: ENST00000517851
  CDS Start-End: 98-600
acttccggtgccctgacctttataggagtaaacagacccccgccatccccgcctcccctcctgcccaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggcccagccctcctctctaccccctgtccccttcctgcggatatagacagcacttccctgcccccactgcagcccctggcgccccctaccccaggttcacccacccatccttgatgctaggttctggtgtacctggtcacccagcagccatcccccacccggccattgtgcccccctcagggaagcaggagctgcagcccttcgaccgcaacct

SEQ ID NO: 192258 - DNA, 1254 bp, Homo sapiens
  Payload ID: 17969
  Gene Name: transcription factor 7 (T-cell specific, HMG-box)
  Uniprot ID: P36402
  ENST ID: ENST00000518915
  CDS Start-End: 80-889
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttgccaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggtgtatgactatgaattc

SEQ ID NO: 192259 - DNA, 584 bp, Homo sapiens
  Payload ID: 17969
  Gene Name: transcription factor 7 (T-cell specific, HMG-box)
  ENST ID: ENST00000518887
  CDS Start-End: 217-584
gcgccgccccagttgcgcgcggccctcggggtctccagcgcgcagagcgtccctgccccggcgtcggccccgacccccgcggtcccaccgcccctcactcccctccggttctccctccaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcc

SEQ ID NO: 192260 - DNA, 553 bp, Homo sapiens
  Payload ID: 17969
  Gene Name: transcription factor 7 (T-cell specific, HMG-box)
  ENST ID: ENST00000519447
  CDS Start-End: 64-366
aatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctggtaagtggaccccgcagccagtgccgccctgtgcttgcagcctccttgaccagcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcaga

SEQ ID NO: 192261 - DNA, 2968 bp, Homo sapiens
  Payload ID: 17970
  Gene Name: transcription factor 7-like 1 (T-cell specific, HMG-box)
  Uniprot ID: Q9HCS4
  ENST ID: ENST00000282111
  CDS Start-End: 276-2042
ggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggcggagaggcgcccgcagcccgtccgggacactttccagaagccgcgggactatttcgccgaagtgagaaggcctcaggacagcgcgttctttaaaggacccccgtaccctgggtaccccttcctgatgatcccggacctgagcagcccgtacctctccaacggacccctgtctcccggaggagcgcgcacctacctgcagatgaaatggcccctcctcgatgtcccctccagcgccacagtcaaggacacgaggtcaccatctccagcacacttgtctaataaagttcctgtcgttcagcacccgcatcacatgcatccgctgactcccctcatcacctacagcaatgaccacttctcccccggctcccctcccacccacctctccccagagatcgatccaaagacaggaatcccccggccccctcacccatccgagctgtcaccgtattacccactctctcccggagctgtcggacaaatcccccaccccctcggctggctcgtcccacagcaaggccagcccatgtactcccttcctcccggtggcttccggcacccttaccccgccctcgccatgaacgcctcgatgtccagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaagtggcacaacctgtctcgagaagaacaggccaagtactacgagctggcccggaaggagcggcagcttcactcgcagctctacccaacctggtcagcccgggacaactatggtaagaaaaagaagaggaagagagaaaagcagctgtcccagacacagtcacagcagcaagtccaggaggcagagggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccaccaaaccagaaacccgggcccagctggctctccactctgccgccttcctgtcggctaaggctgcagcctcctcctctgggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccggccccatggtctggctcctgtcacctgggtccgtgccagcacaatctgccaaagttctagagaccctgttcccttccccatcacctcacatgcttcttctgtgtgtatttctttttgtttttatggtttttggagcaatttaaactcccagttgtttattttcacaaaagaaaataaaattgcagttgcaagacctttt

SEQ ID NO: 192262 - DNA, 559 bp, Homo sapiens
  Payload ID: 17970
  Gene Name: transcription factor 7-like 1 (T-cell specific, HMG-box)
  ENST ID: ENST00000442813
  CDS Start-End: 474-559
aaacaggtgcttggggcagctaaaaataaccaccctgggaagtgaaactgtggcagtgccaaggagctaagaacgtggtgatttaccagaagtcttcagaggcaagccatcttcaattcagaaggggaatcccacatgtgtgttgaatatgaggcattgtttaagacacctcctgccctcaccacattggcaaactgacagcgtcaacttgaaacaagtctgcacattgtggccattttcactccacaacaaatgtttggtctccctctgtcacccaggctagagtgcagcgaaatcacagctcactgcagcctcgacctcctgggctcaagagatcctcccacctcagccttctcagtagctgggactacaggatataagtggattcgtatggtgtgtagccttttgattctggcttcctctgctcactaatatgcacttgaaattcatccacattgctgcagtacctgcagatgaaatggcccctcctcgatgtcccctccagcgccacagtcaaggacacgaggtcaccatctccagcacacttgtctaataaagt

SEQ ID NO: 192263 - DNA, 620 bp, Homo sapiens
  Payload ID: 17971
  Gene Name: transcription factor 7-like 2 (T-cell specific, HMG-box)
  ENST ID: ENST00000277945
  CDS Start-End: 1-620
ctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttact

SEQ ID NO: 192264 - DNA, 1174 bp, Homo sapiens
  Payload ID: 17971
  Gene Name: transcription factor 7-like 2 (T-cell specific, HMG-box)
  ENST ID: ENST00000349937
  CDS Start-End: 306-1172
ttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggcaaggtcaaccagtgtacccaatcacgacaggaggattcagacacccctaccccacagctctgaccgtcaatgcttccatgtccaggtgagt

SEQ ID NO: 192265 - DNA, 4029 bp, Homo sapiens
  Payload ID: 17971
  Gene Name: transcription factor 7-like 2 (T-cell specific, HMG-box)
  Uniprot ID: Q9NQB0
  ENST ID: ENST00000352065
  CDS Start-End: 508-1887
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcagtctttgaatttggaatattacaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192266 - DNA, 667 bp, Homo sapiens
  Payload ID: 17971
  Gene Name: transcription factor 7-like 2 (T-cell specific, HMG-box)
  ENST ID: ENST00000346198
  CDS Start-End: 1-667
acgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtcagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacag

SEQ ID NO: 192267 - DNA, 4021 bp, Homo sapiens
  Payload ID: 17971
  Gene Name: transcription factor 7-like 2 (T-cell specific, HMG-box)
  Uniprot ID: Q9NQB0
  ENST ID: ENST00000355717
  CDS Start-End: 508-1977
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtcagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192268 - DNA, 4073 bp, Homo sapiens
  Payload ID: 17971
  Gene Name: transcription factor 7-like 2 (T-cell specific, HMG-box)
  Uniprot ID: Q9NQB0
  ENST ID: ENST00000355995
  CDS Start-End: 508-2367
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192269 - DNA, 1274 bp, Homo sapiens
  Payload ID: 17971
  Gene Name: transcription factor 7-like 2 (T-cell specific, HMG-box)
  ENST ID: ENST00000369386
  CDS Start-End: 112-474
caggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcagatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaa

SEQ ID NO: 192270 - DNA, 738 bp, Homo sapiens
  Payload ID: 17971
  Gene Name: transcription factor 7-like 2 (T-cell specific, HMG-box)
  ENST ID: ENST00000369389
  CDS Start-End: 186-716
caggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaa

SEQ ID NO: 192271 - DNA, 1041 bp, Homo sapiens
  Payload ID: 17971
  Gene Name: transcription factor 7-like 2 (T-cell specific, HMG-box)
  ENST ID: ENST00000369395
  CDS Start-End: 86-1039
gcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtccagagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggtgagt

SEQ ID NO: 192272 - DNA, 3802 bp, Homo sapiens
  Payload ID: 17971
  Gene Name: transcription factor 7-like 2 (T-cell specific, HMG-box)
  Uniprot ID: Q9NQB0
  ENST ID: ENST00000369397
  CDS Start-End: 306-2096
ttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192273 - DNA, 768 bp, Homo sapiens
  Payload ID: 17971
  Gene Name: transcription factor 7-like 2 (T-cell specific, HMG-box)
  ENST ID: ENST00000470254
  CDS Start-End: 1-327
gctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcagatgcaaatactccaaagaagtgtcgggcactgttcgggcttgaccgacagactttatggtgcaaaccgtgcagtctttgaatttggaatattacaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagc

SEQ ID NO: 192274 - DNA, 4092 bp, Homo sapiens
  Payload ID: 17971
  Gene Name: transcription factor 7-like 2 (T-cell specific, HMG-box)
  ENST ID: ENST00000545257
  CDS Start-End: 508-1938
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccagctttctgtcttctaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcagatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192275 - DNA, 3778 bp, Homo sapiens
  Payload ID: 17971
  Gene Name: transcription factor 7-like 2 (T-cell specific, HMG-box)
  ENST ID: ENST00000534894
  CDS Start-End: 508-1734
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192276 - DNA, 4136 bp, Homo sapiens
  Payload ID: 17971
  Gene Name: transcription factor 7-like 2 (T-cell specific, HMG-box)
  ENST ID: ENST00000542695
  CDS Start-End: 826-2430
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtccagagccccctcccttgctgcactcagggacatgactgtcagcacttctaccccccctcagacttcactgtcagcactcaagtcttcagggacatgaaaaggagccactccttacaaaaagttggggagccctggtgtattgagtctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192277 - DNA, 4037 bp, Homo sapiens
  Payload ID: 17971
  Gene Name: transcription factor 7-like 2 (T-cell specific, HMG-box)
  ENST ID: ENST00000543371
  CDS Start-End: 508-2331
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccagctttctgtcttctaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192278 - DNA, 4000 bp, Homo sapiens
  Payload ID: 17971
  Gene Name: transcription factor 7-like 2 (T-cell specific, HMG-box)
  Uniprot ID: Q9NQB0
  ENST ID: ENST00000538897
  CDS Start-End: 508-1956
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192279 - DNA, 3953 bp, Homo sapiens
  Payload ID: 17971
  Gene Name: transcription factor 7-like 2 (T-cell specific, HMG-box)
  ENST ID: ENST00000536810
  CDS Start-End: 508-2247
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 192280 - DNA, 3680 bp, Homo sapiens
  Payload ID: 17971
  Gene Name: transcription factor 7-like 2 (T-cell specific, HMG-box)
  Uniprot ID: Q9NQB0
  ENST ID: ENST00000627217
  CDS Start-End: 351-2159
cccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaaccctccattttcagtccggcagcacacattactctgcgtacaaaacgattgaacaccagattgcagttcagtatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataaca

SEQ ID NO: 192281 - DNA, 1755 bp, Homo sapiens
  Payload ID: 17971
  Gene Name: transcription factor 7-like 2 (T-cell specific, HMG-box)
  ENST ID: ENST00000629706
  CDS Start-End: 1-1755
atgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccagctttctgtcttctaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgatgcaaatactccaaagaagtgtcgggcactgttcgggcttgaccgacagactttatggtgcaaaccgtgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatag

SEQ ID NO: 192282 - DNA, 973 bp, Homo sapiens
  Payload ID: 17972
  Gene Name: transcription factor A, mitochondrial
  Uniprot ID: Q00059
  ENST ID: ENST00000373895
  CDS Start-End: 115-759
tgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaac

SEQ ID NO: 192283 - DNA, 663 bp, Homo sapiens
  Payload ID: 17972
  Gene Name: transcription factor A, mitochondrial
  ENST ID: ENST00000395377
  CDS Start-End: 1-658
agagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaagtgagtattacggttgttagtctcaagtgtctacttaggatatctgtgagagaatgtattagggcaaggcttgattcatgtgaagacaaccttgtattactaataatacaagtattctaaaatta

SEQ ID NO: 192284 - DNA, 5414 bp, Homo sapiens
  Payload ID: 17972
  Gene Name: transcription factor A, mitochondrial
  Uniprot ID: Q00059
  ENST ID: ENST00000487519
  CDS Start-End: 527-1267
ctgagacgctccgctgggcgcgcagcagccgccgatcggacctcggggtcctggatgcaggactgtctgttacgtacagcccttgtgaccgtcacgggcggacaccggccaacgccgggttggggtgaggccgccgccgcggtccctccatcaccctcctggcccggcagaggaacccactgctccgggcggccggggacagaggtggctcaacagcgccgcctcgaagccagagccctccgcaggctagaggattgcggtttcccttcatctccgcggctcttattcctcccccgcaaggccgcccaccggggtacgctctcccgcgcctgcgccaattccgccccgccccgcccccatctaccgaccggatgttagcagatttcccatagtgcctcgctagtggcgggcatgataacacacgccggagggtcgcacgcgggttccagttgtgattgctggagttgtgtattgccaggaggctctccgagattggggtcgggtcactgcctcatccaccggagcgatggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaaaagtagaagattgagatgtgttcacaatggataggcacaggaaaccagttaggtctcaatacctgaagctatcgtaaaattaagaaaggataaagttggtaaaccttttatatttagtatctttttattcagctcatggacttctgccagcataatacttgctttggaaaacccagataaaggttcatgcaaactttattttgtgtttaggaactactgaggatcagagtaatccaagcaaatgtgaatcattttacctttgacaaaggtaaatcagactatgaagttttttttatacaggatgatgactatggaaagagtactcttgtttccttatattatggaggcaggagtttcgttttcaaaattgttacaaattgtagaagccacggtgttctgtgatataagtgtgtgtttttcataaagcaggcagaactcatctaggtaaattacagttcctaggtataattcacattgtattcagagttgatggttgtacatataagtgattgctggttttagttgcaactttgtataaaagggactgagaaatttataaacttttttcttactgtcttttttctaaagtaaaaacaaagaaattatgtgccagatttatgcatattattttatgttgcatagaataaaatttttaatctttaattttacatttcctaaatatattttaagacgaaacatttgttctatagcttttccctttttttaagtaaggaattttatttttttctgaattattttctctcgtgagtatattgatccagaaagaaaacttgtattatgtgtgttttaaaatgagaaatctaaaaaacgaaaagtctccaaagtctctggaatttgaaacactttgcataacgtataaaagcctgtttaagagacagccaactatggcctgtggatcaaatccagcctgctgcctgctttttatggcctgtgagctaggaattgtgtttataattttaaatgtttttttttaaagacttttatgatacttgaaaattaacatgaatatttagtgttcataaataaagtttgttgaaacacaaccaagatcattcttttacttgtctatggctgcttttctgtggcagagtagctgccacagaaactatagcccacaaagcctgatatttactgtctgtctgtttatggaaaaaatttatcaacccatggtctatagtatagtgtgatatgactactgttccaatgtattgaagtgttgggatagttttttcaaatgttttcagatgttcttgttttagaatcattgtcacctttaagaggaaaaaggtcatcactagataatctaaacaaattgttgcttctcagtgttagcaaggaaaataatctagtttcaaattacattgcagtataatgaaaaagatccatatactgtggaatgatattcttttaaaattatttgctatggcttggtaaaaatgtactttttccagtagcacatatcacaagaacctcactgtagttgaaagccatctttctttagtatttgtttatccttttaggagagtcaagcaaaggttttcaccacctgtttgagcagaataattctcatcagttcacagatataggataactcaatttatatgcactttatgcgttatgcaaaatatttagaaattgtagattctagatctccagaaagactttgaagactttgatgtcacaaaaagatgacttgttatatgctgagcttgacaaaggtaggaatgggagagaaaaatagtagcttatgaggaaatatgaggctttaaatatataaagttggatattttaaaataacttttccctgtgggagcttctcactctgggtgcagacaggacagtgttggccattggtgaaatagataggatgggtttgaggccagagcagtctgggagtagggggaaagagaaggaggtgtgctagtgtctatcacaggctttctcaattaggtttgcaggagaaaaagccctaagtccctgtgtcatctagaatggtactaattatgtacagtccctaggagaatggagaaaatcataactcaaatcatcgactcaattctgttctcttcagatgagctcagagagcacataggagtgtttgtaatgaggggtatgtaatgattgagatagaggaatgagttacataaacatctcgggacaaatgcagcatagaaaacatctttgtagttaccctgcggggaaatttcctctgagttcttttaacattaactacccgtattattttatacttaacattcatatcataccttcccaaatatattgggaagttcagtgttaagtacgtttctcaagtacttaacaacttaatatagggaggaaaggtgtaaacagtgaaaaaagagcaaaactattttatggtaattttatggtagtatcagcttgtatttggttctctgtttctaaaataatgtaatttttaatattttaaataataggataacctggtttccaagcctttttttcccccgacatccagaatacacactggatccaagcctttcttaaacatcagtacatgtggaagactggcatgccatataccaaatgccattcagctgtaacagtatacacagattttctcttataaagaataagaacatcataaccaatgaccactcatataaagtcttatttgtgtgtgtgtgtgtgtgtgtgtgcacgtgtgtgtgttagagtctcattatattgctcaggctggagggcatggtgtgatcttggctcactgcagccttgacctcctgggctcaagtgatccttccgagtcgttgggactacagtaggtgaacaccaccatgcctggctaatttttgtattttttttttaatcaagatgggatcttgctatgttgcccaggctggtctcaaactcctggcatcaagcgttcctccttccttggcctccttaagtgctgggattataggtgtgagccaccatgcttgaccataaagccttactatttcttttggagacacagtcttgctctgtccaagctggaatgcagtgatgtgatcatggctcactgcagccttgaactcccaggcttaagagatcctcccatctcagcctcctgagtagctgggattataggtgcagaccatcaagccttgctattattttttagacttttcttaatttcatccaacaaagtagttgctgtaggagctgagtgttagaaggaaagatgctgaagaaatgaaatcaagcagggtgtatactgtcatgaataggcatacagtagtttttatacttttgttctttggagtaccaatgttaggttttacaaaagtaatttgatgaggggaaggagggttgtgtatttattttactttctgatgtttgcttaaataatactgtgtacgtattcagcttgctgtaattctgtaattacgctattgcgtttggctaactcctttttggaaatgtctttttttttgtacaaggcatgtgttagtttttactaattgctctgaatgtgtatatttagatttctgaattgaaaaaaaatagcgtacaataagtagatttaaagtaattagaacactttattgatttttctgatgttttctgtatctaaaatttatcaccaccaggttgtgctaaaacagcaggaagtttttatattgtgagtgacagtacccattatttctcttaattttactaacatttactataagaatattctctcgctcttttctccactcacagccattctccctccttctcttcataacatcaagctgtcacagacaaatctgaaaatgttacaagcacagactatgttgtatgttttgaaattttagaacagtaatgttctttttaaaattgaacttctgcagagtaagaaaatgaatacatttattactttaaatttgtaaaattttccaaagtaaaaccatacaaagctagtgtcagtctctctcattgttcacaaataaaggacttttgttaattgattaaatcacttactatattcgatatgaaatatataaaacatacaaccattatctaatacatttcagaatgtttcactggttacaggagccagtaaataaagttgactctaaacaggaattttaaataaactaaacattttttcatcaccaag

SEQ ID NO: 192285 - DNA, 2035 bp, Homo sapiens
  Payload ID: 17973
  Gene Name: transcription factor AP-2 alpha (activating enhancer binding protein 2 alpha)
  Uniprot ID: P05549
  ENST ID: ENST00000319516
  CDS Start-End: 189-1490
tggcggagtgaattcctgggccagcgcgcatgcgtcggcaggtagcaacccagctctttatgaccaggtgagatgttggtgagcaggtaaaaaaggaggatttgcctaagcgattccagggagctggcccgaccgagccctccagcccatgcccggcggggaccagtcgccaggagcgcagagccgcgatgtccatacttgccaaaatgggggactggcaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaa

SEQ ID NO: 192286 - DNA, 2576 bp, Homo sapiens
  Payload ID: 17973
  Gene Name: transcription factor AP-2 alpha (activating enhancer binding protein 2 alpha)
  Uniprot ID: P05549
  ENST ID: ENST00000379608
  CDS Start-End: 779-2074
cacgcacgcagacacattctccctctctgcgctctctccttcggtctccctctctgcctctttctctttcacttttgcatgccctgcaaccttttaaaatgttgccccttccctgtgattcgccagacgccgcgccgcggccccccgcgcgctcgcccgctccctctctcgctcgctttttgtctctcgcgctccctctccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaa

SEQ ID NO: 192287 - DNA, 3317 bp, Homo sapiens
  Payload ID: 17973
  Gene Name: transcription factor AP-2 alpha (activating enhancer binding protein 2 alpha)
  ENST ID: ENST00000379613
  CDS Start-End: 258-1577
tccgagcgcacacgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttatttatgttga

SEQ ID NO: 192288 - DNA, 987 bp, Homo sapiens
  Payload ID: 17973
  Gene Name: transcription factor AP-2 alpha (activating enhancer binding protein 2 alpha)
  ENST ID: ENST00000466073
  CDS Start-End: 1-987
atgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagaggacagatatgcaaagagttcaccgacctgctggctcaggaccgatctcccctggggaactcacggcccaaccccatcctggagcccggcatccagagctgcttga

SEQ ID NO: 192289 - DNA, 582 bp, Homo sapiens
  Payload ID: 17973
  Gene Name: transcription factor AP-2 alpha (activating enhancer binding protein 2 alpha)
  ENST ID: ENST00000461628
  CDS Start-End: 1-244
gtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggtgcagagatggcagcggttctgaggcaagagtactgaaatttgctttataatttacttgattatccaagttgtgcatttgaagaaacacatccatgtttccgtagtgcttagtgctatgggtgaaagaaatcttaaagtcaagcagagaagaaaaaaataaaacccacgcatacctcagaaaagcccaattcaactcctaacatcacccaaccaccccatcccagaagaatgaaaccatggagcacaacaggtaatatcagttttcacacctctgcatccccttttaggatgctccgggatatttttccttgtgaatttcagtgaacgattcttttctatattaaacttggtttactacctgagttgcacaggta

SEQ ID NO: 192290 - DNA, 617 bp, Homo sapiens
  Payload ID: 17973
  Gene Name: transcription factor AP-2 alpha (activating enhancer binding protein 2 alpha)
  ENST ID: ENST00000465858
  CDS Start-End: 99-617
ggggagcgcacggtgcccctgtccgaggaaagctcaagaggaggccgaggagaggaccagtgcagcgagcgggccggtcccgggcagggcgccgggtcatggaggagccgcgcagcagcgggcagccgagtcccgagtcccagactcggctgcgaagcggcggagcccgcggccagacagggccgggaagcgcctgccgcgccgagagccccacgagcgcccggacgcggtcccaagcagctcctacccgctacgcacgacccccgctgcatcccgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacagg

SEQ ID NO: 192291 - DNA, 2071 bp, Homo sapiens
  Payload ID: 17973
  Gene Name: transcription factor AP-2 alpha (activating enhancer binding protein 2 alpha)
  Uniprot ID: P05549
  ENST ID: ENST00000482890
  CDS Start-End: 354-1667
gcagattaacacagctaaaagtcggttcccggtgatttattttgatgcacgcacgagacggtatctagacttgcaggcacacacacgtctgtttttaggctcaacttcagaagcgggtgtgcagttccataggagttctgtattcgtgtccacgttgcacccaggaaaccttagcctgaacaccaatttgaactgtcagttggccctagcttcacacaaacaggagaaaaattgtttaacccctggagctgtcaagtaacctcttcaggccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtg

SEQ ID NO: 192292 - DNA, 675 bp, Homo sapiens
  Payload ID: 17973
  Gene Name: transcription factor AP-2 alpha (activating enhancer binding protein 2 alpha)
  ENST ID: ENST00000475264
  CDS Start-End: 1-656
ggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagtggtcatttttcctgataaatgcatccaccagatcctacagagaaggaaataaaatgcctgaaatgagaaaa

SEQ ID NO: 192293 - DNA, 1894 bp, Homo sapiens
  Payload ID: 17973
  Gene Name: transcription factor AP-2 alpha (activating enhancer binding protein 2 alpha)
  ENST ID: ENST00000488193
  CDS Start-End: 216-581
cgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaa

SEQ ID NO: 192294 - DNA, 417 bp, Homo sapiens
  Payload ID: 17973
  Gene Name: transcription factor AP-2 alpha (activating enhancer binding protein 2 alpha)
  ENST ID: ENST00000498450
  CDS Start-End: 10-417
cgccgatccatgaaaatgctttggaaattgacggataatatcaagtacgaggactgcgagcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcaggg

SEQ ID NO: 192295 - DNA, 2739 bp, Homo sapiens
  Payload ID: 17973
  Gene Name: transcription factor AP-2 alpha (activating enhancer binding protein 2 alpha)
  ENST ID: ENST00000489805
  CDS Start-End: 580-921
ccccactccgatttgctacactgagactcccgtcaatggactgcattgagagccggctccggcgcgagttgcctctccgcttcacgctcgatttccaggcattcttcccttattaagtattcgtgtaatattaatagtcatgaatatctgctattaggaggctccaggaacgctgcccagcgcggttattagaagctcaagcgaagccgccgctaagaaaagagggggagacacggattaaggaacacgcacgcacccacacactcacacatactttttcctttttccttttttggggtttttcatttttaaagaactttgaatcataaccagtcgcggcaggatagagaccgtgggttcgaccagctgaaggcgccgcgcgaatcggtggttcaagttcggatggatccgagccgggctcccgcgctccggggagcgtcggcgccgtgactggagtcctgggtggcgcggggctctcggcgccttttgtgtggggcgcgctcgggcggcggggcagccgggcgctccaggcttgcttgtttttttccaccctgactcgttaccccagactcttcgcagatgttagttcacagtttttcagccatggaccgtcacgacggcaccagcaacgggacggcacggttgccccagctgggcactcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaa

SEQ ID NO: 192296 - DNA, 797 bp, Homo sapiens
  Payload ID: 17974
  Gene Name: transcription factor AP-2 beta (activating enhancer binding protein 2 beta)
  ENST ID: ENST00000344788
  CDS Start-End: 203-797
tttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgagatgttagtccacacctattcatccatggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaag

SEQ ID NO: 192297 - DNA, 5773 bp, Homo sapiens
  Payload ID: 17974
  Gene Name: transcription factor AP-2 beta (activating enhancer binding protein 2 beta)
  Uniprot ID: Q92481
  ENST ID: ENST00000393655
  CDS Start-End: 170-1552
tttttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaatcaaagcctgtgtgtcagaattctgcaggtgcacttctttaaagaagctcaaagggaataatttagaaagtggccaatatgatggaagcagctttgaatctacatgctaacattcctcaacactccaattccggtggaggtggcaggggagggggtctgcaaaatgaattttaagggaaaagagtaaggattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacgagatctttgcaataccccttaaagataacgacatagatgttgttctgcaggatttatagttaggacccactcaattctccaggactcccggttttgcccccctcccgctttgccttggtgggggtggggattgggggagtggggattgcgttggggttttaggaatctgctgagagctttgcccatttttattaaaagaggaaagggaagttaggaagctcgtctcaggtcaccaaaagggcccaagcaactgttagggccacactgcagcccatctccaacccctagcttcgtttagcacttctgatcttcatggcccagccctagaactgttgagaggaatgcaatggccaagagctagacgttacggagagtgtagtcactctcttttcccagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagcccactaccccttctccctccctcacttctcctttcatgtaggacccccgcccccttgctttccttagccaggcccgctacatttatctgataattgagttattaaaagatttggtttccttgggcctataaatcaataaacagtaggattaacgcaatagtttgccttttaagtcaagggagacgtttaaggcaagcccctttgagctttgttttcaaaccaaacaggtgagttgcagctctccccccggcccctgcactcttcagacatttggtccctgcccactcctaaacgctcagtcccaaaacaaaatagcgaaagacaggaggagtcaggatgtggcagtgctgccttcacactttccacttcgcaagttcttttaaaggttccaaagatctccagaccattctctgccaaaccctgccgcctcctgcacgtattgcaggtctctggggagcaagaaatgtcctgtttgggtgaggattccgtcacctaaaaagatctttaacttctcccccaaagtgggaaggtaactttctcccccttttccccaccaccttcactcctacacccccaattaccttgcattttctttccttccttctggcctccacacccatagctttcctccatccccacttaaagaaccgaagaggcttttaaagacctggctgctttgttttccttggccaaggaagccactttctctcaagcaattatttcatatcctacgaaaactttggtcgaatggaaaactcgaaacctcgagcttatctacacactgttcctctgctacaatgctttcctagttaagagtgtttatagagaatttgtcatcacatctgatatcctgtacttgtaatacattatgtggaaaggaaataaccttaaaccgtctgatgttgcctcaagagcccaaacggcgtttccccacctttgacgatgtatgtgaaattactggcttaaaaaaaaaagtatcaatttttttttaacggaatgaacactatccttctttaaatgccaaaatcgactccacctttgagttggtctctaattctctaacattgtttttgccacacaatcaagaaatatcaatctattgactcttcacgagaagagctctggagggtattcatgttaagtttgtatatatttatttatgcttaatttaatgggaatgtgtaaatatggcgagcaagtagtttgggattatttatctgtgaatctatacctctgtgaatgggtggttaaaaaacctcttgaccctagatagaatcctatctgaatttttctgttctttataaacaagctgttatggtaatgggtagaaattggtttattgtccagtgttaatctgatttacataaataaaaagattgttgtgttttca

SEQ ID NO: 192298 - DNA, 1711 bp, Homo sapiens
  Payload ID: 17975
  Gene Name: transcription factor AP-2 delta (activating enhancer binding protein 2 delta)
  Uniprot ID: Q7Z6R9
  ENST ID: ENST00000008391
  CDS Start-End: 229-1587
agggagctgcttttgtgcagagggaaaattttgttcctacaggtttttaagtgggtacgaggcaaggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgagatacgtcacgacggatcaaacagctaccgtttgatgcagcttggctgtctggagtcagtagccaattccactgtcgcctattcctcctcctctcctttaacttactccaccaccggcaccgagtttgcgtccccctacttctccactaaccaccagtacaccccgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcagggctctgtggaggcccagtgtgggcttgttctcaatggccaaggtggagtgataagaagaggtggcacctgtgtggtcaaccccacagacttattttgctctgtccctggccgtttgtcccttcttagttctacttccaaatacaaggtgaccattgctgaggtaaagaggcgcctctccccacctgagtgcctcaatgcttcactcttgggaggcattttgagaagagcaaaatcaaagaatgggggccgctgcctgagagagaaattggataggcttggcttaaacttaccagcaggaagacggaaagcagctaatgtcaccctccttacttccttggttgaaggggaggctttgcacttggctcgggattttggctacacttgtgaaacagagtttccagccaaagcagtaggagaacatcttgccagacaacatatggaacagaaagaacagacagcaagaaaaaagatgatcctggcgaccaaacaaatctgtaaagaattccaagacctcttgagccaagatagatcaccactgggatcctccagacccactccaattctagaccttgacatccagagacatttaacacatttcagtttgatcactcatggctttgggactccggcaatatgtgcagctctaagcactttccaaacagttctcagtgaaatgctgaactacttggaaaaacacactactcacaagaacggcggagcggcggattctggccaaggacatgccaactcggagaaagctcccctgcggaaaacttcagaggctgccgtgaaagagggcaaaacagaaaagacagactagctacatcaaacagaatctatttccagagagtcttgctgctgatattttttctaatatatatatcattgagggtgactaatcttcagtggaccaaatctctacccttccccaaccctccataaaa

SEQ ID NO: 192299 - DNA, 2189 bp, Homo sapiens
  Payload ID: 17976
  Gene Name: transcription factor AP-2 epsilon (activating enhancer binding protein 2 epsilon)
  Uniprot ID: Q6VUC0
  ENST ID: ENST00000373235
  CDS Start-End: 209-1537
gtgcccgtccgtcctgcctccatggacccgcccgggaacggccaccgctgaggaccccacgcccactaggatcccggctgggtcgcacccagctaccgcaccgtgacctccgcgggctgtgccggctcccggcgcctctgcccgcagcgctcgccgtcgggctagggctccgccgccgccacgcctcgcgcccggcactcaccgccccatgctggtgcacacctactccgccatggagcgccccgacgggctgggagcagctgccggcggggcccgcctgtcgtctctgccccaggcggcctacgggccggcgcccccgctctgccacacgccggccgccacagctgccgccgaattccagccgccctacttcccgccgccctacccgcagccaccgctgccctacggtcaggcgcccgacgccgccgcagcctttccccacctggcaggggacccatatggcggcctggcgcccctggcgcagccgcagcctcctcaggccgcctgggccgcgccccgcgcagccgcccgcgcccacgaggagcctcccggcctgctggcaccgcccgcccgcgccctgggccttgacccgcgccgtgactatgccactgccgtgccccggctcctgcacggcctggccgacggcgcgcacggcctggcagacgcacctctcggccttccggggctggcggcggcccccggtctggaggacctgcaggcaatggacgagccgggaatgagcctcctagaccagtccgtgatcaagaaagtgcccatcccctccaaagccagcagcctctcagccctctccttggccaaagacagcctggtgggcggcatcacaaatcctggtgaggtcttctgctccgtgcccggccggctttcactgctcagctcaacgtccaagtacaaggtgacggtgggggaggtgcagcggcgactctcgcctcccgagtgcctcaacgcctccctcctggggggtgtcctccgcagggccaagtccaaaaatgggggccggtgtttgcgggaacggttagagaagattgggctcaacctgccagctggccgtcgcaaggccgccaatgtgacgctgctgacttcgctagtggaaggagaggccgtgcacctggcccgagacttcggttacgtctgtgagacggagttcccagccaaggcagctgccgagtacctgtgccgacagcacgctgacccgggggagctgcacagccgcaagagcatgctgctggctgccaagcagatctgcaaggagtttgcagacttgatggctcaggaccgctcaccgctgggcaacagccgcccagcactcatcctggagcccggagtacagagctgcttgacacactttagcctcatcacccatggcttcggtgggcctgccatctgtgctgccctcactgccttccagaactatttgctggagtcactcaaggggctggacaagatgtttctaagcagtgtgggcagtgggcatggtgaaaccaaggcttcggagaaggatgccaagcatcggaaataactgcttctcccaccccatccctaaggggctcccaggccctgaaatagggacttagctcttgggggtgggcctggaaggactgaaaggtgggattagagtcaggccagaaagagaacattcatccagagatcccagagttggggatctggcttggagtaagggagggtggcctctctgtggtggtgtgttggtaagttaagggcccaggtatttgtctcatgtgtgcaattttctgacctttgatggttgagaagggtttggacagaaaattgacatgaaaagatctggctcatggggcagagccctttccattagcgtggctgggtggccgtgggtgcttctagaggccaaagcctttgtgtttttcactggtggcaggaggaaaattgataaatcagaggtgctactgaggagttggtgcccctcattccagaatctcctacccccagaaaaggggtgctggaaggaggccccagtggactctttgtacccttcctactctcagagagaagtgggcaggaggggtcctcaaggaacaaagaagataaagcacaaatcgcagaacttgaatccaggctgctgctcatcatagtcctgttgctgtctgtcctatttatttatgtatgttgtaattaaatttgaaattttaaaa

SEQ ID NO: 192300 - DNA, 2866 bp, Homo sapiens
  Payload ID: 17977
  Gene Name: transcription factor AP-2 gamma (activating enhancer binding protein 2 gamma)
  Uniprot ID: Q92754
  ENST ID: ENST00000201031
  CDS Start-End: 244-1596
cgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcagaatgtcgacgaccagcacctgttgctgcacgatcagacagtcattcgcaaaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaagagccaaatcgaaaaatggaggccggtccttgcgggagaagttggacaagattgggttgaatcttccggccgggaggcggaaagccgctcatgtgactctcctgacatccttagtagaaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaa

SEQ ID NO: 192301 - DNA, 482 bp, Homo sapiens
  Payload ID: 17977
  Gene Name: transcription factor AP-2 gamma (activating enhancer binding protein 2 gamma)
  ENST ID: ENST00000416606
  CDS Start-End: 128-482
cgagctcaggggcgccgggagcgcggagctcgggctacggactcgcgggagttcactgcgcctccgggccctggagggctgcccctgcccgcaggcccgggcgcttccgccaggaggcgacagcgccatgttcctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggc

SEQ ID NO: 192302 - DNA, 2215 bp, Homo sapiens
  Payload ID: 17978
  Gene Name: transcription factor AP-4 (activating enhancer binding protein 4)
  Uniprot ID: Q01664
  ENST ID: ENST00000204517
  CDS Start-End: 330-1346
aaggaggccgggggagtgctgagttttcaccagctgtttcccgccttgaaacagacatctgatcagctgcaaacacacacacacacacacacacacacacacacacacacacacacacacatacacacgcccggggaggcaggccggagagacctccctcccgcccctcccgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttcttttttttttttttttacaattttgaggtcttcgtgttcaaggagaagctattatattttgttaagaaagtggggagaaaaaaaccaagaggccaccgtgcctttgtaaagaaacaaaataaagtttgtactttgtttttta

SEQ ID NO: 192303 - DNA, 507 bp, Homo sapiens
  Payload ID: 17978
  Gene Name: transcription factor AP-4 (activating enhancer binding protein 4)
  ENST ID: ENST00000572393
  CDS Start-End: 163-507
tggccactgctcctgcaagggtcagcagcgctccccacagcatggtgggagcctcgcttctccggcgcaggccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcag

SEQ ID NO: 192304 - DNA, 785 bp, Homo sapiens
  Payload ID: 17978
  Gene Name: transcription factor AP-4 (activating enhancer binding protein 4)
  ENST ID: ENST00000573476
  CDS Start-End: 86-589
cgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagacggaggaaaccgaggcttggtgttgcacagctaccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccag

SEQ ID NO: 192305 - DNA, 595 bp, Homo sapiens
  Payload ID: 17978
  Gene Name: transcription factor AP-4 (activating enhancer binding protein 4)
  ENST ID: ENST00000574639
  CDS Start-End: 149-283
ctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgag

SEQ ID NO: 192306 - DNA, 1424 bp, Homo sapiens
  Payload ID: 17979
  Gene Name: transcription factor B1, mitochondrial
  Uniprot ID: Q8WVM0
  ENST ID: ENST00000367166
  CDS Start-End: 57-1097
ggagcggcggtgaaggtcctgggtgaggtagggttggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacgattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtacaagctttcttttaatatatactgtatagatagttatgacatgtttagtataaacagcatctattacaatctatcttacaaaaatgaagtatctgcacattttgcccctaaaccacattaaaataacttaaatatgctttaaataaa

SEQ ID NO: 192307 - DNA, 1848 bp, Homo sapiens
  Payload ID: 17980
  Gene Name: transcription factor B2, mitochondrial
  Uniprot ID: Q9H5Q4
  ENST ID: ENST00000366514
  CDS Start-End: 187-1377
gaggcggaagcggaagtgagggagaaaagcaggaaggctccgctgttcgcatgcgcaggctctagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataagaag

SEQ ID NO: 192308 - DNA, 3415 bp, Homo sapiens
  Payload ID: 17981
  Gene Name: transcription factor binding to IGHM enhancer 3
  Uniprot ID: P19532
  ENST ID: ENST00000315869
  CDS Start-End: 261-1988
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcggtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttg

SEQ ID NO: 192309 - DNA, 3279 bp, Homo sapiens
  Payload ID: 17981
  Gene Name: transcription factor binding to IGHM enhancer 3
  Uniprot ID: P19532
  ENST ID: ENST00000493583
  CDS Start-End: 185-514
tgggcgggggatgactcacagcccatcccatctccccgacgccgcccgcccgcgcagtgctagctccatggcttagcggaggaggcggcggtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 192310 - DNA, 3546 bp, Homo sapiens
  Payload ID: 17982
  Gene Name: transcription factor CP2
  Uniprot ID: Q12800
  ENST ID: ENST00000257915
  CDS Start-End: 460-1968
gagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgctacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctatgttttttaatagaagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtgtttaaagcatttgataaggtttaaatgttttttatacagagatttttgttcattaaactcaatctgcatcatggtctaatttctcttggtttgaaacaaattgaaaactttgaaaccaaaaaattaagtcaatgacttgtttaaaactgacctgagcaacttgttatattac

SEQ ID NO: 192311 - DNA, 1862 bp, Homo sapiens
  Payload ID: 17982
  Gene Name: transcription factor CP2
  Uniprot ID: Q12800
  ENST ID: ENST00000548115
  CDS Start-End: 491-1843
gactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagaaaccaatgatagctatcatatcatactgaagtaggagtgcggcgtttcgtgcc

SEQ ID NO: 192312 - DNA, 1508 bp, Homo sapiens
  Payload ID: 17982
  Gene Name: transcription factor CP2
  ENST ID: ENST00000548108
  CDS Start-End: 366-1508
ttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaaggtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcag

SEQ ID NO: 192313 - DNA, 1727 bp, Homo sapiens
  Payload ID: 17982
  Gene Name: transcription factor CP2
  ENST ID: ENST00000549867
  CDS Start-End: 95-1369
ttcgccgggcaggcgaggaaagaggacgccatgattggttggcgctggggcggcggacggtggaagggcctggcgagtctaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaagggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggag

SEQ ID NO: 192314 - DNA, 9292 bp, Homo sapiens
  Payload ID: 17983
  Gene Name: transcription factor CP2-like 1
  Uniprot ID: Q9NZI6
  ENST ID: ENST00000263707
  CDS Start-End: 99-1538
accgcgggttcggagcgcgaagccgccgctgggtcctcggcgcgccccgcgtctgcgcttgctgccgcgccccggtcggcgcgctgggagttccagccatgctcttctggcacacgcagcccgagcactacaaccagcacaactccggcagctacctgcgtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagagcatcatccgtgtggtcttccatgaccgccggctgcagtatacggagcaccagcagctggagggctggcggtggagtcggccaggggaccggatcctggacatcgatattccactgtctgttggtatcttggaccccagggccagcccgacccagctgaatgcagtcgagtttttgtgggaccctgcgaagagagcttctgcattcattcaggtacactgcatcagcacagaattcacccccaggaagcacgggggcgagaagggagtgccctttcgagtccagattgacacgtttaagcagaacgagaatggggagtacacggagcacctgcactcagccagctgccagatcaaggtgttcaagccgaagggagccgatcggaaacagaagactgaccgggagaagatggagaaaagaactgcccaagagaaggagaaataccagccgtcctatgaaaccaccatcctcacagagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcctggaagagctgaccaccttggagctgattgagaagatcgccaacctgtacagcatctccccccagcacatccaccgagtctaccggcagggccccacgggcatccatgtggtggtgagcaacgagatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctaactatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccgtggcattcctacagaacagagtgaggacaggctcctgattcctcttccttctttagaggagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtctttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaactatacttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttaccttttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaagtgtgctattagtagagtcttccatttttctggcatgcccctggcatctgctcttcttaccttctcgtggttgtagttaaagcttatagcttatgaaagaatagaaaataataaataccaaaaaaaagtacacatggtaatttggtaccaaaatatctcagctgcctaatttagcagctcatcccttccacaggggtcagatgagctaaagctccaggttttatttttcatttgattgacatacagaaaagccatagcccttcccacagctgtccagggtctttcctgtgagtccggaggtgctggcctattgagcaggacagctcttcccagggcattcccaccaacctgtggcttctgaactgtagcttctttttacagtgaaccccagagggaaataagacagacacatgtgctcaggccaccatcttgaactggaagcccaaagctgagttccttactcttaggtcgtcacggtttttgcggggtatctgcaaggttgagataaaccctttcctgtttaccaggttgtcctttctggatgaagggacagaggctgttgaatggaggaataataggtttgctggaggaggggcatggtatgcctgtggaaaggacaggatggggtggggaggtcgaggctttgacttggggtcctaaacaaaggtcaggtgttgccctagtgacctcttgcccagacagcccagagccccttacacagagctattaacctagggaaggctttaccagcagtggactggagccagccagggtcacaagtttccaagtccagcattgcttcaggggctggcctgagtaactgaagatctgaaaatcattaacaagtcgatgaaataaacggaaaagcctcttaggctgttgtcagtggagcagagggagaaagtccctaggcgctcagagggggtgagaaagcagtggatgattgggcgggggtgggggattagatgttgacactgcctggggtgtaggaagaggaacagagaacccagagtcagggtcctagatcccagaccctcgctcagtatgagtctctttgcctctctgggtctctatctcctcctcttacaaatacaggcttggtgatctctgaagatggcaccaacctgccatgaaatgaatctgaggggttttcccatttttccctccatcaaaatcgtacaaaaagctggacgtggtggcccatgcctctaatcctagcattttgggaggccgaggtgggagaatcacttgacgccaagagttcgagaccagcctgggcatcgtagtgagactccatctctgtctttttgaaaataaaaaatctttgaaaattgcacaacaggcaggagacctttacgtgtgcccatcctggttgtacacagtgccaccagtgctcctgcagtgcaaggcggcatgcttcttgacatgggtcagattgtgtccatcgtgtctttgggaatcagccctagctcctaactgggctgactacttcctccgcaaacttatgggggctcccagatattccttgccagccaggggccagacacagtgcaggcacagtctgtgtcattggtgcacatgtgcgtgtttacatgtgtacctgggttccttcccttgcccatgaatttgccatgagcacagccagaagcagcctcagcttggcaaggtgtggagatgactgctgttcccttcgcatttggggaaaacaggctccctcggtagctcgatgatcctcttttgatcttgtgtgacctcctggagagtggatgaagctggtggccttagcttttctagacagtgtaagtggcactgggcaaggcccccagagcagggcaaggtctctagagcgggtctcccacatgactggcttcacacaggcacttccgctcgggttgcatgctctgtgtcatcttaccggtccagggttgcaggtaggaaatgtttgtaccctcttctgattgccacctccttcccatcgccccttagggacagggcttgagggccagtgaggcgctggtcaggcaccccaggcctccttgggacctgcccaggggcaccctgagagctcctgaaacccccacttagcttccagacctttctgcaaaagctcctcctggctttcctccctcccccaatctatgggtcacagctaacagatctgagggcaactgctgtgctagtggccagggctgcacctgccatccccggctctgccactttagggccttctagaggcagtgtccttaggaagtagctctgaggcatgggttttctgctcctgtgcagggcagctgatgggataaggtggggaaggacggtcagtgcttgggccccagctggccagcctggcgatggggaaaccaaaccatgtcccccagcgaagggccagagtgggaacctgtcctcatgcccttcgtcctgaggagccctgaggtgggcagcaggggccaggggaagttttcaggccttcatcaaagagaacaacatcctcagctccgcacccctcatcctgtatcagcacttaccggtgtgtgactgcccttgtcagctagcatacggtgggcccacctggcccactggctgtttatgccactgatttatgatagggaatattatctttgaacccaatgaagtgttttctcccccatcacaaaaaaaaaaattcttatttttagtagacatgtatttaccaaaaatatgtactcaattattgtattttggattttatcaatttaaaaattgtggaaatttgtttgctcttacgccaacataatattgattttgcctcttggctctgaaagcccaaaatatttaccgtctagcccgttacagaaaaagtctgctgactactgagccagacctccattacctccatccctgttggattatttaaagaaagcctcagacagtaagggcttttttaaaagaataaaatgacttggtttgcgcttggaagcaggggaagcattcagatgagcggtttctgcattaaccctgcctatcacgcatctcgtgtcctgtgtggctggcgagccccccttggaaggttctggtgcttcagctggctcctgcagagtccaccccgcctcgtggtgggaatgcagagccctttgctttccttcttgccgcctgcttcctgttcctggggacccgctgggcctttggtctgcatcccctggccaggtccctcagggttgatgcgtggagaaggactttgagcagtggtgggcagcagtggcctcctggccagctcacactcttgtcctgggaggggcagcctgatctcacctccacctagtaccttggggactgaggaccttttggcttctctggagcctgcaagcctcttcccatgtgtccagctgctcttcctgctacaaaggggactgctcacagtggcctcagcttggtggttttgaggggccgccccccggccctccataagggtatcctgggcctgagaattctgcatctgccattggaggatggacagcctcaaatggaaggagtcccacgggagatgggtccgaggtccggctgtggccatccagccccctgtggcttgtccagcctctgtgcacccctggtgtcttcactccaggggcagacagcagccactgcagttcctttcttcgtgagtaacagtagtgatagcagctggggctaacaggctaggctttgtgttctgcgcatttggtcagcttctcactcgatcctccctaaagcaatggggaggcccccactagcccagttttcaggaagtcaactgggaggttagatgggggccagggtcccacagctactgatggcccgagccaggttgagcttcctggtgtccagtccggatcccacttgcagatctcatgctctcagataggtgggacaagttcttttgtcacagtgctggctctgtcctgaggcctcattgctggctgggtgtgctctgctgggaaaagctttgcggggcttgcttggttaaccacagaagagaaggggactgtttggggtgcctctctgcagcctccccgtgctgggtggaagcacggttactgtgttctctaatgttcatgtatttaaaatgatttctttctaaagatgtaacctccacacctttctccagattgggtgactcttttctaaaggtggtgggagtatctgtcggggtggtgtggcccttggatgggtcaggtgggtgtgagaggtcctggggaggtgggcgttgagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtaagaaa

SEQ ID NO: 192315 - DNA, 1680 bp, Homo sapiens
  Payload ID: 17984
  Gene Name: transcription factor Dp family, member 3
  Uniprot ID: Q5H9I0
  ENST ID: ENST00000310125
  CDS Start-End: 90-1307
cacggcagccctacactcggcctggaagaattgtttttcttctctggaaaggtgaacatttatagcatttatttcccaaatctgttaacatggcaaaatatgtcagtctcactgaagctaacgaagaactcaaggtcttaatggacgagaaccagaccagccgccccgtggccgttcacacctccaccgtgaacccgctcgggaagcagctcttgccgaaaacctttggacagtccagtgtcaacattgaccagcaagtggtaattggtatgcctcagagaccagcagcatcaaacatccctgtggtaggaagcccaaacccacccagcactcactttgcctctcagaaccagcattcctactcctcacctccttgggccgggcagcacaacaggaaaggagagaagaatggcatgggcctgtgccgtctttccatgaaggtctgggagacggtgcagaggaaagggaccacttcctgccaggaagtggtgggcgagctggtcgccaagttcagagctgccagcaaccacgcctcaccaaacgagtcagcttatgacgtgaaaaacataaaacggcgcacctacgatgccttaaacgtgctgatggccatgaatatcatctccagggagaaaaagaagatcaagtggattggtctgaccaccaactcggctcagaactgtcagaacttacgggtggaaagacagaagagacttgaaagaataaagcagaaacagtctgaacttcaacaacttattctacagcaaattgctttcaagaacctggtgctgagaaaccagtatgtggaggagcaggtcagccagcggccgctgcccaactcagtcatccacgtgcccttcatcatcatcagcagtagcaagaagaccgtcatcaactgcagcatctccgacgacaaatcagaatatctgtttaagtttaacagctcctttgaaatccacgatgacacagaagtgctgatgtggatgggcatgacttttgggctagagtccgggagctgctctgccgaagaccttaaaatggccagaaatttggtcccaaaggctctggagccgtacgtgacagaaatggctcagggaacttttggaggtgtgttcacgacggcaggttccaggtctaatggcacgtggctttctgccagtgacctgaccaacattgcgattgggatgctggccacaagctccggtggatctcagtacagtggctccagggtggagaccccagcagtcgaggaggaagaggaggaggacaacaacgatgacgacctcagtgagaatgacgaggatgactgacgtcctctcgccttaagattcagcttcaggaaaacatttagggaaaagaaactttttttttttttttaatgtgaggttttctgtttcttttttgcctactcccaagaagatattggtaagctatagaatttagatatgcacctctgataagcaaggattgtttcccgtatgattaagacgtgctgttgatgtgtgttttgataccagtgtgctgacacagaatctttatttactttttaggattttgtgttttcattttctatttttctttaaatgcagagttcattgttgccccttaacagtttttcctgagtttactgaagaaattgtacttcatccacatccatgaaaataaaatgctctccttttgtgc

SEQ ID NO: 192316 - DNA, 2648 bp, Homo sapiens
  Payload ID: 17985
  Gene Name: transcription factor Dp-1
  Uniprot ID: Q14186
  ENST ID: ENST00000375370
  CDS Start-End: 213-1445
cgtcccggcgccactcggcccagggcagggaccccgccacggccgggaccgcccggcccggccccagcccgcgcctctccgcgccgccccgcgctccgcaccgcgccctctccgcgtccccgcccgcgcggccggaccgggcagccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcgaaaagaaactttttttttaatgtgggttttctgtttccttttggcctactcccaagaagatattggtaagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaa

SEQ ID NO: 192317 - DNA, 866 bp, Homo sapiens
  Payload ID: 17985
  Gene Name: transcription factor Dp-1
  ENST ID: ENST00000408980
  CDS Start-End: 160-866
gtcagagttaccggtcagccgggcgggcgccgccggggtctggggtggacgccgcgagcctgcacgttgcgccgggaccccggggctgtgcccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacct

SEQ ID NO: 192318 - DNA, 792 bp, Homo sapiens
  Payload ID: 17985
  Gene Name: transcription factor Dp-1
  ENST ID: ENST00000453989
  CDS Start-End: 317-792
aggtgggtggtggggcacccccctgcagcggcgggagggaggcgctgcgccctggctcctggggctcggccccaccctcggccgctgggcgggccgtcggggacctgggggtagtggtggtgaccctgcgggcccgcgggccacttttccgcagggggcatttccgtctggcgaggcgactgaaaatcctgagtgtgggagtcggtttggccagctccgctctcaggatggagggtgcctttgggaaggaagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggtaattggtacgcctcagagaccggcagcgtcaaacaccctggtggtaggaagcccacacacccccagcactcactttgcctctcagaaccagccttccgactcctcaccttggtctgccgggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagt

SEQ ID NO: 192319 - DNA, 1571 bp, Homo sapiens
  Payload ID: 17985
  Gene Name: transcription factor Dp-1
  ENST ID: ENST00000544902
  CDS Start-End: 220-579
gtgcggaggcggcccgaggcctagtgacaggcgcgcggcgcggaccccggaagcccacctgtcagagttaccggtcagccgggcgggcgccgccggggtctggggtggacgccgcgagcctgcacgttgcgccgggaccccggggctgtgcccagaaaaatcatttttcttctctgggaaggtgaacatttgtagcattgatttcccggatctggtaacatggcaaaagatgccggtctaattgaagccaacggagaactcaaggtcttcatagaccagaaccttagtcccgggaaaggcgtggtgtccctcgtggccgttcacccctccaccgtcaacccgctcgggaagcagctcttgccaaaaacctttggacagtccaatgtcaacattgcccagcaagtggaagcgcaacaggaaaggagagaagaatggcaagggcctacggcatttctccatgaaggtctgcgagaaggtgcagaggaaagggaccacttcctacaacgaagtggcagacgagctggttgcggagttcagtgctgccgacaaccacatcttaccaaacgagtcagcttatgaccagaaaaacataagacggcgcgtctacgatgccttaaacgtgctaatggccatgaacatcatctccaaggagaagaaggagatcaagtggattggtctgcccaccaactcggctcaggaatgtcagaacttagaggtggaaagacagaggagacttgaaagaataaaacagaaacagtctcaacttcaagaacttattctacagcaaattgccttcaagaacctggtgcagagaaaccggcatgcggagcagcaggccagccggccaccgccacccaactcagtcatccacctgcccttcatcatcgtcaacaccagcaagaagacggtcatcgactgcagcatctccaatgacaaatttgagtatctgtttaattttgacaacacatttgaaatccacgatgacatagaagtgctgaagcggatgggcatggcttgcgggctggagtcggggagctgctctgccgaagaccttaaaatggccagaagtctggtccccaaggctctggagccatacgtgacagagaagacaggcttatgtgactgcacagcgggatgtcctgctccgtggcgcagtgtggaaaatactggacaagcgaaggatatccggaagcttctacagccgtctgtcctgtggaactgcgcgtcattttgttggttgcctgtgcgtcttgtgttgtttctgtttcatgaccattcgcttattttctttcccttttcagaaatggctcagggaactgttggaggcgtgttcatcacgacggcaggttccacgtctaacggcacaaggttctctgccagtgacctgaccaacggtgcagatgggatgctggccacaagctccaatgggtctcagtacagcggctccagggtggagactccggtgtcctacgtcggggaggacgacgaggaggacgatgacttcaacgagaatgacgaggacgactgacgtcctccccacttcagattcggcttcaggaaaacgtttagcg

SEQ ID NO: 192320 - DNA, 578 bp, Homo sapiens
  Payload ID: 17986
  Gene Name: transcription factor Dp-2 (E2F dimerization partner 2)
  ENST ID: ENST00000475734
  CDS Start-End: 441-578
aaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgg

SEQ ID NO: 192321 - DNA, 878 bp, Homo sapiens
  Payload ID: 17986
  Gene Name: transcription factor Dp-2 (E2F dimerization partner 2)
  ENST ID: ENST00000497579
  CDS Start-End: 218-878
gaaactcgtggtgcttttgctctgctttcaagatgcattaagtctcctgctttgtgactgctttggagccagcagatactctgatatgtataattcaaattatgcaggtttcacgagcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaa

SEQ ID NO: 192322 - DNA, 1469 bp, Homo sapiens
  Payload ID: 17986
  Gene Name: transcription factor Dp-2 (E2F dimerization partner 2)
  ENST ID: ENST00000487734
  CDS Start-End: 9-221
agtttgacatgacggcaaaaaatgttggtttgacttccacaaatgcagaagtaagaggatttatagatcagaatctcagtccaacaaaaggcaacatttcatttgttgcatttccagtttccaataccaactcacctacaaagattttaccaaaaaccttaggaccaataaatgtgaatgttggaccccaaatggatgcaaccagaaggcatcatctttgaagcagagaataaaccctcaccaggcactgaatctgccggcactttcattttggacctctcagcaacctccagaacaattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagccta

SEQ ID NO: 192323 - DNA, 1201 bp, Homo sapiens
  Payload ID: 17986
  Gene Name: transcription factor Dp-2 (E2F dimerization partner 2)
  Uniprot ID: Q14188
  ENST ID: ENST00000479040
  CDS Start-End: 27-1184
caataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagccta

SEQ ID NO: 192324 - DNA, 865 bp, Homo sapiens
  Payload ID: 17986
  Gene Name: transcription factor Dp-2 (E2F dimerization partner 2)
  ENST ID: ENST00000467667
  CDS Start-End: 121-865
gcatgcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatcc

SEQ ID NO: 192325 - DNA, 746 bp, Homo sapiens
  Payload ID: 17986
  Gene Name: transcription factor Dp-2 (E2F dimerization partner 2)
  ENST ID: ENST00000478006
  CDS Start-End: 129-746
agactgtagaatgttgttggtactgcagtgagaggcatgcttccttagaccagattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctcc

SEQ ID NO: 192326 - DNA, 1853 bp, Homo sapiens
  Payload ID: 17986
  Gene Name: transcription factor Dp-2 (E2F dimerization partner 2)
  Uniprot ID: Q14188
  ENST ID: ENST00000467072
  CDS Start-End: 661-1821
gctccgccgccaaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggtaaatacctagaagtggaattgctgggtcatatggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtga

SEQ ID NO: 192327 - DNA, 1403 bp, Homo sapiens
  Payload ID: 17986
  Gene Name: transcription factor Dp-2 (E2F dimerization partner 2)
  Uniprot ID: Q14188
  ENST ID: ENST00000477292
  CDS Start-End: 101-1033
gtagaatgttgttggtactgcagtgagaggcatgcttccttagaccagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacg

SEQ ID NO: 192328 - DNA, 1442 bp, Homo sapiens
  Payload ID: 17986
  Gene Name: transcription factor Dp-2 (E2F dimerization partner 2)
  Uniprot ID: Q14188
  ENST ID: ENST00000495310
  CDS Start-End: 156-1205
actgaatggtaacaaagactgtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatg

SEQ ID NO: 192329 - DNA, 379 bp, Homo sapiens
  Payload ID: 17986
  Gene Name: transcription factor Dp-2 (E2F dimerization partner 2)
  ENST ID: ENST00000474279
  CDS Start-End: 1-343
agattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaaggtacgtatttttttcagggttagaaaggcaaaccccagagccctgactgtctgtgtaggggtgagccggggtcatgttactg

SEQ ID NO: 192330 - DNA, 571 bp, Homo sapiens
  Payload ID: 17986
  Gene Name: transcription factor Dp-2 (E2F dimerization partner 2)
  ENST ID: ENST00000467634
  CDS Start-End: 315-571
ttctggcttttaaaaaaactgtgttgtttctgtaataaaatctgggaatgtgtagtcccagctactcgggaggctgaggcaggagaatcgcttgaatccgggaggcggaggttgcagtgagccaagatcgtgccacttcactccagcctggtgacagagagagactacatctcaaaaaaaaaaaaaaaagaaaagaaaaaaattctgggaaccccatgactggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcacc

SEQ ID NO: 192331 - DNA, 416 bp, Homo sapiens
  Payload ID: 17986
  Gene Name: transcription factor Dp-2 (E2F dimerization partner 2)
  ENST ID: ENST00000488107
  CDS Start-End: 149-416
ctgtaatcccagcactttggggggccaaggtgggcggatcacctgaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgt

SEQ ID NO: 192332 - DNA, 2360 bp, Homo sapiens
  Payload ID: 17986
  Gene Name: transcription factor Dp-2 (E2F dimerization partner 2)
  Uniprot ID: Q14188
  ENST ID: ENST00000486111
  CDS Start-End: 189-1349
gacacagtctcaagtttccactgaatggtaacaaagactgtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcgcaggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtg

SEQ ID NO: 192333 - DNA, 9857 bp, Homo sapiens
  Payload ID: 17986
  Gene Name: transcription factor Dp-2 (E2F dimerization partner 2)
  Uniprot ID: Q14188
  ENST ID: ENST00000489671
  CDS Start-End: 432-1772
aaagctcgcgcgggggaagcggggctgtagctgggcagggagagggcggacgaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgttggtttgacttccacaaatgcagaagtaagaggatttatagatcagaatctcagtccaacaaaaggcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatcatgtggatttgtcccaagattatgctagatgcaccaagcatggcccaaattggttcttttttaaatcccatgggggaagtgcaggctccttcctgtggtgcctctttatagcctcaccaccatgctaacactgagcatggtgaggaggaggaagctttggctagctaaacatgtttaataaggccataaaaactgagaaagaaaaacattcaactttagctgaagctcctttgatacaaaagtttcattctgtcagaaataagccatagtacagactcagagatagaggcagtttctagagaactcggtcttatcgtgggttctggagcacacctctcagaccagtcaggaacactggggaggtgacagcaggtccccaggggcctgcagggaatctttcagctgcacggattgggatttccctccaaaccaaactgtcctttaaggggcagcctcctcttttactaactccaccctttctcatctctgggacccagcagggacctggagaggccaacagccactgctacctttgtagtcttcaaaatattgaactgcaggtcccaagatgcatttcaggatttaagacaggtgcactaatgataaccattccttcaccaagtagcaacattcttgccagagttcttgggaaacctgtttttttctctactctccatctctgctgctctcatgctttaaattgataaaatatgggctcaaaaaaagaaagccgccaaagactcttatccttattggtgccccatcattggccaccccagccataggtgtgtgctgttggtgggaaatggtctccttcctcagcgttgtgtttgggttactggtgaggccagctcacagagtgacatcatggtcaccagtacatgtcgctggagtaaaatcttgcctttagaaactaggttgagctgttcagaaaggtcaattctcttctgtattccccctcaacatttatctgggtctaaagctcagcactgagtcacaatttcacacaagatcaaagtgaggcagtgttaggaaaccatgggctgggtgcagtgcctctcgcctgtaatcgtagcactttgggaggccgaggcgggcacattgcttgagctcaggagttcaagaccagcctgggcaacatgacaaaaccctgtctctacaaaaatacaaaaattagctgggtgtggtggggcatgcctgtagtcctggctactcaagaggctgaggtgggaggattgcttgagcgcaggaggcggaggttgtagagccaagatcacaccactgcactccagcctgggtgacagagcaagaccctgtctcaaaaaaaaaaaaaaaaaaaatggaagttgtggtcacaatgcccaggcttctttgttatagtggcacgctgggttacttgccacacacagatcactcctcccagggctgctggcacacactgattgtggggagttcaagaggccttttccccttgagggtgtggctgtccccctttcaggcgtgtggcgtcattcatggaggaagtgctggctctacttagcacacgcacagtggcactaggacctgcgtgcctggccctcagtgggtagggcggtgctgcctaggcacacagcagcgcttacgggccccaggtgcctactaggctgccttcctcttccccgctgtcagtctgtgtcctccacgtgcttatttcctgtggtgagagcagttgtggtgtttgtataccttgtgccttatgatcaaggtgggccttggaggagggcgggaaaggagcgaccaacatggcggtcctccacccctcagcgacacccaccgcccgagaaactacagacaatggccacaagtttggcgtccttcaatttaattctttaaagaagtgctgggaagaaaaagctatgtggtttctaccattttagcaggataaagaggataactccttccattagcaaattttacagttgttaacagtactctgccatatttgaaaaataatgccagagtcagtccttgaaaacaaggtagctcctatcagaattcaaatggaaattttttttttttttttttttttttttgagactgagtctcgctctgttgcccaggctggagtgcagtggtgatctcggctcactgcaagctccgcctcccgggttcacgccattctcctgcctcagctgggaccatgcctggctaattttttttgtatttttagtagagacggggtttcaccgtgttagccaggatggtctcgatctcctgaccttatgatccacccctctcggcctcccaaagtgctgggattacaggcgtgagccaccgcacccggcctcaaatggaaatatttcacagaggagtggttcagtttagccctgcaagacatctataacttgactgtttgctaaaccacaactctttttggctacttgggtcatagagacagcagagttgctccaagtataaatgtgacttaggctccctccagcacacagtgtgtatgttggagggagtgtggattagcagagaatgagaactacctcagctattcctgccataaccacactgagagaggggggcacggtggggagcctatttagcttttttttttttttgagacggagtcttgctctgtcgccaggctggagtgtagtggcgcaatcccggctcactgcaacctctgcctcccgggttcaagcgattctcctgcctcagcctcccaagtagctgggattataggcgcatgccgccacacccgactaattttttgtatttttagtagagtcagggtttcaccgtgttgcccaggctggtgtcgaactcctgacctcaggtgatctgcccacctcagcctcccgaagtgctgggattacaggtgtgagccaccgcacccggctctatttagctttttaaaaattatttcctttcaagggccctttaatatctatcaagctccctcccctaacaaaatgggctgtccctgcccaacaagtctgaaatagaccttaaaactgtgctgccttagtggtaagtaaggggtgggggttggacagtgaatcttaagatttcatccttcattcagtaagcatttgagtacctactgtgagcaggcattggggcggagcagcgagagccctgccgatgttgggttctcctcctattggggaaacttgatcacagatggaacacgtgcagattgattgatgagtgctgtggagaaagcagcagcgtagcgggaccgtttgggaaaggctactttggctgggggtggctgggaaaggcccctctgggaaagagacagttttactgagtcagatggtggaaagacagatgtctctatactttcttaacaagccactctgtcccataacatgcacttggaatctctcctaagttccagaggccccactgttccagtttcaagccttcattttggagtctgtttgggaacttttaagacttcaaagcaaagttagctaccagcaatttctgtaaaccaagagaagattgtcacaaagattcactactttccaactgaatctatgcagtagaaaaatcattagaaaatacaaaaattagccgggcgtggtggcacatgcctgtagtcccagctactcgggaggctgaggcaggagaatcacttgaacccaggaggcggaggttgcagtgagccaagatcccgccactgcactccagcccaggtgacagagcaggactctgtctcaaaaaaagaaaaaagaaagaaagaaaaatgattagaaattgagaactattttacgtgtttctaagttgttggctacatcaaagagatcatctgtattctgcatatgggctggctttggtgaagctgatgactggacttctaagaaccgttttcccaaatgggttcccatattcatgcacccaaagcaatggtccccaagcactgatgaaaactaatatgcatttcccaaagacccacactatgtatcaggagcctgcaccatgccatttgaatgaccctcagcaatgtgcctccctgccctcaaattcccagttgataacagtgtttgattaaatttccactcaagccaaacatggttactaagaagagaaaaacctgatgtttgcataatattttttttcccctcgagatggagtcttgctctgttgcccaggctggagtgcagtggcatgatctcagccactgcaacctctgcctcccgggttcaagcgattcttctgcctcagcctcccaagtagttgggattacagacatgtgccaccacgcctggctaatttttgtatttttagtagagacagggtttcaccatgttgaccacactggtcttgaacttctaaccatgtgatctgcctgcctcggcctcccaaagtgctgggattacaggcttgagccaccacgcccagcctaagattttatgattaaaaaaaattcaagctcaatacccacataaattataacgtttctcaggaagtagtcccttaaccaaaacgtctctgagaagtgatgcttaggtaatctctgggatccgattttcccacatgtctcactccacagtatgctaaagaagaaaaagtgagtgggcacaacactttgaccctctggctaagccctgggagtccctgacaggtccagaaacttctctgacacccattcaccagggtgctgagataggagaaagtgctcatttataatgtgtattctgtgcagctgttctcagacaagaccggatcttgtcatcttaccttttgctttacaaaaaaggcctgttgaagtcaatgctgtcttgccccttgctgtttcagcaggttagactttggtcttcactgcttatagctgcattggaggccaacgtagctgatgctcagggtcaggcctcgccccttcgccgcaggtctcaggatcggggataacatcgctcccaccctgctcatttagagatgggaaacaagcaagagcttgacttgcctcccatccctcagcctgtctgtggcagagcctgcaccaaaacccagagcttcttccctccgtgagggccacgctgtcaccacagtcctcccagatgggttttggattagcatcagtcctgtgtcaccaagtgccaaacagctgaggggtagaagtgggactcctttcccgagccccagcatgaggctgtggtgtcaggtttaggcctctctcaagtcagaaaaccccgggctgagacctccacagacaagggctccccatgctggccattggcaggggcccaagaagttcagtgaccaactggtccttccacaccacaccagctggtgctgcccatgtctgtcgaatcataacggaaaattccccagatcacgtttggatttaaaaactcatcccttgtcgtgcttcaatgcatgccatttgtcacttaccatacttcaccatggccgagcttcatgtcacatggcctggcgattgtgcttgttcacactggggccaggattttcatactaaaacgtcactgacaatggggctacttttctcctgaatagctcctctgggcttgttgcagttctagttttcccagtagttccatggcaggttcaacctctcagtgtcctgaaaaatggaaccacccactaaccatatgcactggctgcccaggtggctgcactccggggatcacgtttcagtactgagttccttcacgcacttggttcaccaccatcactcttgagttttggacaaaagaggtgggtatgccaggcacagtggctcacgcctgtgatcccagcactttgggaggccgaggcgggcggatcacctgaggtcgggagttcgaaaccagcctgaccaacatggagaaaccctgtctctactaaaaatataaaattagccgggtgtggtggcgcatgcctgtaatcccagctactcgggaggctgaggcaggagaatctcttgaacccaggaggcaaaagttgcaatgagctgagatcgtgccatttgcactccagcctgggcaacaagagcgaaattccatctcaaaaaaaaaaggtgggtaaagggccatgagcccaaaccactaggttgttcaccttttcatctgaaaatgctttactctgactatgtgctattgggttttatttccagaaaatatagttctccttttttctgcatgaaggatacatcgtggtgccacatgctttaagcaatttaaacaagagagataagaggaaaatgcaaccaccacatctgacttgcccaatgtagactttcctttattagattgaagtacacaacctaatatgatatattattttgtagtatctcagactttgtaaataaatgccattatttttatatggaaattttatagaagagctatttctgtatacgtaattactcctgattttctgaaattgcttctggtagataacagacaagtcctaagcagtgttccactaagggtggttccaggcctgcctgccgtggagttgactgggggaattttacagttttgcgatcctaggatgcgtcccagacgctcagtcagaagtgctggaggtggggcctgggaagctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacactttaaaataa

SEQ ID NO: 192334 - DNA, 578 bp, Homo sapiens
  Payload ID: 17986
  Gene Name: transcription factor Dp-2 (E2F dimerization partner 2)
  ENST ID: ENST00000494358
  CDS Start-End: 497-578
gaaatcggtagcgatctcggctgcggcgctgccgcagctgcccggcccgcggggcgcgccctgacccttcatctttgggcaggctcgagggcgcgcgcacggttggcgttctggggcctcaaactcctgggccttgaccgggcaggccgcgtctccccgggtgtgagtccaccgggacccggccgccgcctaagcgcgggcgccacagaagcggcggcgcccgaagacgcgctcctggctcggcccgacagcctcgcttggccgccagttcttctgcagccgaaggcggttgttcttttaaagaattattgaagacgaaggtttttttctttttatttttttaatggctttacagaatcttaaatagaatacagtttgacatgacggcaaaaaatgcaacatttcatttgttgcatttccagtttccaataccaactcacctacaaagattttaccaaaaaccttaggaccaataaatgtgaatgttggaccccaaatgattataagcacaccacagagactaaccagttcaggaagtgttctgattgggagtccatatacccctgcaccagcaatgg

SEQ ID NO: 192335 - DNA, 9335 bp, Homo sapiens
  Payload ID: 17986
  Gene Name: transcription factor Dp-2 (E2F dimerization partner 2)
  Uniprot ID: Q14188
  ENST ID: ENST00000499676
  CDS Start-End: 1-1257
atgcaaccagaaggcatcatctttgaagcagagaataaaccctcaccaggcactgaatctgccggcactttcattttggacctctcagcaacctccagaacaattataagcacaccacagagactaaccagttcaggaagtgttctgattgggagtccatatacccctgcaccagcaatggttactcagacacacatagcagaagctactggctgggtccctggtgatagaaaacgggctagaaaatttatagactctgatttttcagaaagtaaacgaagcaaaaaaggagataaaaatgggaaaggcttgagacacttttcaatgaaagtgtgtgagaaagttcaacgaaaaggtacaacatcgtacaatgaagtcgctgatgagctggtgtcagagttcaccaattcaaataaccatttggctgctgattcggcttatgatcagaagaacattaggcgaagagtttatgatgctttaaatgtgctaatggcaatgaacataatttcaaaggaaaaaaaagaaatcaagtggattggcctgcctaccaattctgctcaggaatgtcagaatctggagatagagaagcagaggcggatagaacggataaagcagaagcgggcccagctgcaagaacttctcctacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacagatatctccacaggaccttcttggttaaatcagggactacttctgaactctacccaatcagtttcaaatttagacctgaccactggtgccaccttaccccagtcaagtgtaaaccaagggttatgcttggatgcagaagtggccttagcaactgggcagttcctggccccaaacagtcaccagtccagcagtgcggcctctcactgctccgagtcccgaggcgagaccccctgttcgttcaatgatgaagatgaggaagatgatgaggaggattcctcctccccagaataaagacaagagaaagcctacgtttcaatatgtgatgctcatgtgtgtttgtagtgtgagctcttgtttttgaaatgattgcttcagtctttgcctttgtttgcactgtgtgttcagtgaaaactagagaaacacaataagcaaatcacatgaaggctgagatgattgagatgaaagttaacatagtgtgaatgaaagtctggccaacagagcagtagatgatataacaaagaaagcatgctttctgaggagatagtggggataatccctgaagagttggcagtgtgagtgcaactcatttatcttctgtgaggtgggatttttgtgttcctcacacccatgtaattattcttagaattgagattgctacacggagcagtccttgacgatcgtgtttctgacgtttctcttccttgcctggactgcctttgacaaggcagaaatgaacatgaaaagtccccaggagaggggagctgtgtagtgagggatactgagggcagtcctgtggctgaggggcacagattgaactgctgaactagttggaggtctagatgaggtgctttacgcatcagctgccttagacagcttctagaaaggagcgagcgctacttcttaagtacttaagtgacatttagataatttatagtaaaactgaaattattattagccaatgcattggtgcatagaatttactagggctacttctggaagccaaaatagaatagcatttccatgtgcattaaatactttgccagcactgcctttgccagcatcctaaatctggagttttacaaagaaggaaactgtatctttaggttaatcaaagctatgcatttcatatagctttttcatttaaaacaagacaaagaaacaaattcctatgaccaaattgcttgcctacagttccctgcagtaattgtatgatctcacccagtgtgcaatttgtgaaaatgaaccaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatcatgtggatttgtcccaagattatgctagatgcaccaagcatggcccaaattggttcttttttaaatcccatgggggaagtgcaggctccttcctgtggtgcctctttatagcctcaccaccatgctaacactgagcatggtgaggaggaggaagctttggctagctaaacatgtttaataaggccataaaaactgagaaagaaaaacattcaactttagctgaagctcctttgatacaaaagtttcattctgtcagaaataagccatagtacagactcagagatagaggcagtttctagagaactcggtcttatcgtgggttctggagcacacctctcagaccagtcaggaacactggggaggtgacagcaggtccccaggggcctgcagggaatctttcagctgcacggattgggatttccctccaaaccaaactgtcctttaaggggcagcctcctcttttactaactccaccctttctcatctctgggacccagcagggacctggagaggccaacagccactgctacctttgtagtcttcaaaatattgaactgcaggtcccaagatgcatttcaggatttaagacaggtgcactaatgataaccattccttcaccaagtagcaacattcttgccagagttcttgggaaacctgtttttttctctactctccatctctgctgctctcatgctttaaattgataaaatatgggctcaaaaaaagaaagccgccaaagactcttatccttattggtgccccatcattggccaccccagccataggtgtgtgctgttggtgggaaatggtctccttcctcagcgttgtgtttgggttactggtgaggccagctcacagagtgacatcatggtcaccagtacatgtcgctggagtaaaatcttgcctttagaaactaggttgagctgttcagaaaggtcaattctcttctgtattccccctcaacatttatctgggtctaaagctcagcactgagtcacaatttcacacaagatcaaagtgaggcagtgttaggaaaccatgggctgggtgcagtgcctctcgcctgtaatcgtagcactttgggaggccgaggcgggcacattgcttgagctcaggagttcaagaccagcctgggcaacatgacaaaaccctgtctctacaaaaatacaaaaattagctgggtgtggtggggcatgcctgtagtcctggctactcaagaggctgaggtgggaggattgcttgagcgcaggaggcggaggttgtagagccaagatcacaccactgcactccagcctgggtgacagagcaagaccctgtctcaaaaaaaaaaaaaaaaaaaatggaagttgtggtcacaatgcccaggcttctttgttatagtggcacgctgggttacttgccacacacagatcactcctcccagggctgctggcacacactgattgtggggagttcaagaggccttttccccttgagggtgtggctgtccccctttcaggcgtgtggcgtcattcatggaggaagtgctggctctacttagcacacgcacagtggcactaggacctgcgtgcctggccctcagtgggtagggcggtgctgcctaggcacacagcagcgcttacgggccccaggtgcctactaggctgccttcctcttccccgctgtcagtctgtgtcctccacgtgcttatttcctgtggtgagagcagttgtggtgtttgtataccttgtgccttatgatcaaggtgggccttggaggagggcgggaaaggagcgaccaacatggcggtcctccacccctcagcgacacccaccgcccgagaaactacagacaatggccacaagtttggcgtccttcaatttaattctttaaagaagtgctgggaagaaaaagctatgtggtttctaccattttagcaggataaagaggataactccttccattagcaaattttacagttgttaacagtactctgccatatttgaaaaataatgccagagtcagtccttgaaaacaaggtagctcctatcagaattcaaatggaaattttttttttttttttttttttttttgagactgagtctcgctctgttgcccaggctggagtgcagtggtgatctcggctcactgcaagctccgcctcccgggttcacgccattctcctgcctcagctgggaccatgcctggctaattttttttgtatttttagtagagacggggtttcaccgtgttagccaggatggtctcgatctcctgaccttatgatccacccctctcggcctcccaaagtgctgggattacaggcgtgagccaccgcacccggcctcaaatggaaatatttcacagaggagtggttcagtttagccctgcaagacatctataacttgactgtttgctaaaccacaactctttttggctacttgggtcatagagacagcagagttgctccaagtataaatgtgacttaggctccctccagcacacagtgtgtatgttggagggagtgtggattagcagagaatgagaactacctcagctattcctgccataaccacactgagagaggggggcacggtggggagcctatttagcttttttttttttttgagacggagtcttgctctgtcgccaggctggagtgtagtggcgcaatcccggctcactgcaacctctgcctcccgggttcaagcgattctcctgcctcagcctcccaagtagctgggattataggcgcatgccgccacacccgactaattttttgtatttttagtagagtcagggtttcaccgtgttgcccaggctggtgtcgaactcctgacctcaggtgatctgcccacctcagcctcccgaagtgctgggattacaggtgtgagccaccgcacccggctctatttagctttttaaaaattatttcctttcaagggccctttaatatctatcaagctccctcccctaacaaaatgggctgtccctgcccaacaagtctgaaatagaccttaaaactgtgctgccttagtggtaagtaaggggtgggggttggacagtgaatcttaagatttcatccttcattcagtaagcatttgagtacctactgtgagcaggcattggggcggagcagcgagagccctgccgatgttgggttctcctcctattggggaaacttgatcacagatggaacacgtgcagattgattgatgagtgctgtggagaaagcagcagcgtagcgggaccgtttgggaaaggctactttggctgggggtggctgggaaaggcccctctgggaaagagacagttttactgagtcagatggtggaaagacagatgtctctatactttcttaacaagccactctgtcccataacatgcacttggaatctctcctaagttccagaggccccactgttccagtttcaagccttcattttggagtctgtttgggaacttttaagacttcaaagcaaagttagctaccagcaatttctgtaaaccaagagaagattgtcacaaagattcactactttccaactgaatctatgcagtagaaaaatcattagaaaatacaaaaattagccgggcgtggtggcacatgcctgtagtcccagctactcgggaggctgaggcaggagaatcacttgaacccaggaggcggaggttgcagtgagccaagatcccgccactgcactccagcccaggtgacagagcaggactctgtctcaaaaaaagaaaaaagaaagaaagaaaaatgattagaaattgagaactattttacgtgtttctaagttgttggctacatcaaagagatcatctgtattctgcatatgggctggctttggtgaagctgatgactggacttctaagaaccgttttcccaaatgggttcccatattcatgcacccaaagcaatggtccccaagcactgatgaaaactaatatgcatttcccaaagacccacactatgtatcaggagcctgcaccatgccatttgaatgaccctcagcaatgtgcctccctgccctcaaattcccagttgataacagtgtttgattaaatttccactcaagccaaacatggttactaagaagagaaaaacctgatgtttgcataatattttttttcccctcgagatggagtcttgctctgttgcccaggctggagtgcagtggcatgatctcagccactgcaacctctgcctcccgggttcaagcgattcttctgcctcagcctcccaagtagttgggattacagacatgtgccaccacgcctggctaatttttgtatttttagtagagacagggtttcaccatgttgaccacactggtcttgaacttctaaccatgtgatctgcctgcctcggcctcccaaagtgctgggattacaggcttgagccaccacgcccagcctaagattttatgattaaaaaaaattcaagctcaatacccacataaattataacgtttctcaggaagtagtcccttaaccaaaacgtctctgagaagtgatgcttaggtaatctctgggatccgattttcccacatgtctcactccacagtatgctaaagaagaaaaagtgagtgggcacaacactttgaccctctggctaagccctgggagtccctgacaggtccagaaacttctctgacacccattcaccagggtgctgagataggagaaagtgctcatttataatgtgtattctgtgcagctgttctcagacaagaccggatcttgtcatcttaccttttgctttacaaaaaaggcctgttgaagtcaatgctgtcttgccccttgctgtttcagcaggttagactttggtcttcactgcttatagctgcattggaggccaacgtagctgatgctcagggtcaggcctcgccccttcgccgcaggtctcaggatcggggataacatcgctcccaccctgctcatttagagatgggaaacaagcaagagcttgacttgcctcccatccctcagcctgtctgtggcagagcctgcaccaaaacccagagcttcttccctccgtgagggccacgctgtcaccacagtcctcccagatgggttttggattagcatcagtcctgtgtcaccaagtgccaaacagctgaggggtagaagtgggactcctttcccgagccccagcatgaggctgtggtgtcaggtttaggcctctctcaagtcagaaaaccccgggctgagacctccacagacaagggctccccatgctggccattggcaggggcccaagaagttcagtgaccaactggtccttccacaccacaccagctggtgctgcccatgtctgtcgaatcataacggaaaattccccagatcacgtttggatttaaaaactcatcccttgtcgtgcttcaatgcatgccatttgtcacttaccatacttcaccatggccgagcttcatgtcacatggcctggcgattgtgcttgttcacactggggccaggattttcatactaaaacgtcactgacaatggggctacttttctcctgaatagctcctctgggcttgttgcagttctagttttcccagtagttccatggcaggttcaacctctcagtgtcctgaaaaatggaaccacccactaaccatatgcactggctgcccaggtggctgcactccggggatcacgtttcagtactgagttccttcacgcacttggttcaccaccatcactcttgagttttggacaaaagaggtgggtatgccaggcacagtggctcacgcctgtgatcccagcactttgggaggccgaggcgggcggatcacctgaggtcgggagttcgaaaccagcctgaccaacatggagaaaccctgtctctactaaaaatataaaattagccgggtgtggtggcgcatgcctgtaatcccagctactcgggaggctgaggcaggagaatctcttgaacccaggaggcaaaagttgcaatgagctgagatcgtgccatttgcactccagcctgggcaacaagagcgaaattccatctcaaaaaaaaaaggtgggtaaagggccatgagcccaaaccactaggttgttcaccttttcatctgaaaatgctttactctgactatgtgctattgggttttatttccagaaaatatagttctccttttttctgcatgaaggatacatcgtggtgccacatgctttaagcaatttaaacaagagagataagaggaaaatgcaaccaccacatctgacttgcccaatgtagactttcctttattagattgaagtacacaacctaatatgatatattattttgtagtatctcagactttgtaaataaatgccattatttttatatggaaattttatagaagagctatttctgtatacgtaattactcctgattttctgaaattgcttctggtagataacagacaagtcctaagcagtgttccactaagggtggttccaggcctgcctgccgtggagttgactgggggaattttacagttttgcgatcctaggatgcgtcccagacgctcagtcagaagtgctggaggtggggcctgggaagctgtatttgtaatgaactctggtgttttttgtccattaaagtgtatctttgtccatcctataagattaaaggaaagaaaaagcatctcaaatgagtgtaagttgttcttgagaaaaaaatgtatcagacttttatgatttgaatgaaatgtattatagaaaaaaataaacacttt

SEQ ID NO: 192336 - DNA, 496 bp, Homo sapiens
  Payload ID: 17986
  Gene Name: transcription factor Dp-2 (E2F dimerization partner 2)
  ENST ID: ENST00000494656
  CDS Start-End: 1-202
tgatagaaaacgggctagaaaatttatagactctgatttttcagaaagggctgaaacttggagaactgatcccagggaaacaactgcctgcttcagctggtttaagaattttagtatgccccagaacaggttttcctcatactggcatttgtatttgtgggaagagagagagaccagactggctgcctgcttgtctgcttagcagcaaatacaacctgaagttaagcttgttgccagcatggcccactcacatccagagaagttgtggttagccctccacaagtgggggaaccttcttaggaaaacaagcgtgcatacaagaagctcatgtaaactctatatattgaaaacttgaatccaacattcgtgaacatgaaagaacaggacatttttggaaaactatgatgaaagaaaaggaacaagatgaataaacaaaagttatgacccaagaggatgtaagataaaaaagaacaataaaataaagttgtaattatca

SEQ ID NO: 192337 - DNA, 2354 bp, Homo sapiens
  Payload ID: 17987
  Gene Name: transcription factor EB
  Uniprot ID: P19484
  ENST ID: ENST00000230323
  CDS Start-End: 303-1733
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 192338 - DNA, 2315 bp, Homo sapiens
  Payload ID: 17987
  Gene Name: transcription factor EB
  ENST ID: ENST00000343317
  CDS Start-End: 6-1694
ctgcaatgagtgaagaagacagaaccttcagttttggtccaggaaccaggaaacttggattcatgtctcagctgtcacccgcttgctcagtgaccttgggcaaatctcttcccctctcagggctcggtgtcttctcctctaaaatggatgcggtcccagtcattctggcctccccctgccagcccctgtgctttgaggaggacacgtgcctcatatacctgctgccccttctcatccacagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 192339 - DNA, 2188 bp, Homo sapiens
  Payload ID: 17987
  Gene Name: transcription factor EB
  ENST ID: ENST00000358871
  CDS Start-End: 95-1567
gaggagaaagtagagaatgatgcctccgcaccctgtgaacttccaacaagggaaggtgacatgaaaggagctcagacaatttctgtccagcaacatgacagcaagctcaggctgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 192340 - DNA, 2331 bp, Homo sapiens
  Payload ID: 17987
  Gene Name: transcription factor EB
  Uniprot ID: P19484
  ENST ID: ENST00000373033
  CDS Start-End: 282-1712
gtggagtgacagccggagcccgggcgccgggcgcggggctcggtgacagcggaggcggcggcccgggcgggacgcagggagcggccgcggcgccgacggcggcgggaagggcggacggggcgggcctccctggtggcacggggccggagcaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttg

SEQ ID NO: 192341 - DNA, 2595 bp, Homo sapiens
  Payload ID: 17987
  Gene Name: transcription factor EB
  ENST ID: ENST00000394283
  CDS Start-End: 1228-2034
agatgcggatgcgctcggttagaacgcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacggtatgctttcaccatgccggtgaccccagccccaggaccacgagcaactcgcctggctcccttctctccgtctgcctcctggccgcggggcccggagagctgggagccagagggtgtaaatgaagggcagagctgtttgggtgactccatgctctgcttctccccgagggaagccaatggtgcttaccatttacaaggcttgttacagctgcagggttattttgtcctcaactcagctctgggagacggagccaaatggggacccaggtatcttggttccgggtgccctggaaggagttcaggggatagggcaggggacaccctaggtgggcactgaatctagggagagccaactgggcttttacgggctaatggcctggtgactcacagtcagaggtgggcagggagtgggccagggcaggcaggagcccttccagggtcccacgtgcgctgtcacaggcctcctcagcctgtttctggaaagctgagaagtaggtggaaggggactcccacccctcaagtctggctgccctttgagggtctagctcttggccctgagccctcctggggctctgtttatgactgtaattgcatcattagccagagttaatagagttacttagcacctgcccccacagggagtagcccagccaccccctgggttctgtctcttccttttcaaagtcaactcggtttctgcaggcaacaggggtttccccaaccacagctgtcatgaaaaccaggttgggcctttgtcctggggatggagggcagtcagcacttggggcctggcttggggctgccctggagatgaccatggaaattgggttggcctcctctgatcggagggtgggagttcagggttcccagagctgccagaaatgttcacgtcccaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctgtgagcaggtttctgagggggagggtgatgggtctgggtgggcagcagctgacaagtattatctgccctcagccccatgctagttactaggatgggaggagaattccttctagaagttcatctatttgagaaaagatctctccctctcccaaatcaggaaagaatcaggaaagctcaagacagatgagtttctgtcctggaagtgaggctgaggtcaagggaggcttcttggaggagcagtcatgctgagaaagttttcttaaggccattgggctggcagacaagaggccgggctcacgcctataatcccagcactgtgggaagctgaggcaggcagatcacttgaggtcatgagttcaagaccagcctggccaacatggcgaaaccccatctctactaaaaatacaaaacttagctgggcacagtggtgtgtgcctacagtgccagctactagggaggctgagacaggagaattgattgaactcaggaggtggaggtagcagtgagccgagatctcgctactgcactgcattccagcctgggcaacagaacgagactccatctc

SEQ ID NO: 192342 - DNA, 1626 bp, Homo sapiens
  Payload ID: 17987
  Gene Name: transcription factor EB
  ENST ID: ENST00000406563
  CDS Start-End: 1-1005
cacttccagtcgccaccacctgtgcctggggaggtgttgaagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgta

SEQ ID NO: 192343 - DNA, 2162 bp, Homo sapiens
  Payload ID: 17987
  Gene Name: transcription factor EB
  Uniprot ID: P19484
  ENST ID: ENST00000403298
  CDS Start-End: 112-1542
gcttcacgcacggctgccccgagctgctccgggctgcgcgagcaggttcgcgccgcagccgcctggcgcgccccagccccgcgccccggggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgt

SEQ ID NO: 192344 - DNA, 365 bp, Homo sapiens
  Payload ID: 17987
  Gene Name: transcription factor EB
  ENST ID: ENST00000445214
  CDS Start-End: 153-365
ggtgtgagctgacgagagcttcaggcctgcttgggattctggccccatgatttagggtttctttggagcccatctgagcctggggggccctgtggtggtggaagaggtccagcctgcggtggtgaaagagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaag

SEQ ID NO: 192345 - DNA, 223 bp, Homo sapiens
  Payload ID: 17987
  Gene Name: transcription factor EB
  ENST ID: ENST00000445700
  CDS Start-End: 188-223
gcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacgggagccagcgccggcagccaccatggcgtcacgcatagggttgcgcatgcagctcatg

SEQ ID NO: 192346 - DNA, 377 bp, Homo sapiens
  Payload ID: 17987
  Gene Name: transcription factor EB
  ENST ID: ENST00000424495
  CDS Start-End: 141-377
ttgaggtccctgcctgctaacctgacgtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatccc

SEQ ID NO: 192347 - DNA, 984 bp, Homo sapiens
  Payload ID: 17987
  Gene Name: transcription factor EB
  ENST ID: ENST00000419574
  CDS Start-End: 317-984
ggtgtgagctgacgagagcttcaggtgggagcctctcccggcagtgaatctgagggttgggagggatttccggacccagagggaagatattttggggccgagggcctttccagaacccatgaaatcacacaccctgctgcgaccagactgaccctccctagttgatggttcttttttggacatcctaggcctgcttgggattctggccccatgatttagggtttctttggagcccatctgagcctggggggccctgtggtggtggaagaggtccagcctgcggtggtgaaagagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcac

SEQ ID NO: 192348 - DNA, 1022 bp, Homo sapiens
  Payload ID: 17987
  Gene Name: transcription factor EB
  ENST ID: ENST00000416140
  CDS Start-End: 289-1022
tgttgggtaggctgcggtgtgggactgtgccgtcggggcgcagttccctctgtgctgtgagtaatcctcggccgcatttgcagctcccaggggattgtgcaacttcctctccagctgaggtgcagggggctgggtgagaaacagcagccgccggggaaatgaggaaactgagcccggccctggggctggggtgcggccctgggctccggcccctggaggagctgagcattccaggggcctccttccagggggctgccctctcgaagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaag

SEQ ID NO: 192349 - DNA, 914 bp, Homo sapiens
  Payload ID: 17987
  Gene Name: transcription factor EB
  ENST ID: ENST00000419396
  CDS Start-End: 112-914
gcttcacgcacggctgccccgagctgctccgggctgcgcgagcaggttcgcgccgcagccgcctggcgcgccccagccccgcgccccggggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacct

SEQ ID NO: 192350 - DNA, 1996 bp, Homo sapiens
  Payload ID: 17987
  Gene Name: transcription factor EB
  Uniprot ID: P19484
  ENST ID: ENST00000420312
  CDS Start-End: 201-1376
cggccgcggcgccgacggcggcgggaagggcggacggggcgggcctccctggtggcacggggccggagcaggccgggagcaggtggcgggcacagcttgcgggccaggcacccgaacttgcgacaagttgccggagccgcggggcgcgggcggcggacagattgaccttcagagcgagggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgt

SEQ ID NO: 192351 - DNA, 281 bp, Homo sapiens
  Payload ID: 17987
  Gene Name: transcription factor EB
  ENST ID: ENST00000425401
  CDS Start-End: 184-281
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggagggagccagcgccggcagccaccatggcgtcacgcatagggttgcgcatgcagctcatgcgggagcaggcgcagcaggaggagcagcgggagcgcatgcagcaacaggctgtcatgcatta

SEQ ID NO: 192352 - DNA, 168 bp, Homo sapiens
  Payload ID: 17987
  Gene Name: transcription factor EB
  ENST ID: ENST00000433032
  CDS Start-End: 133-168
agctccagccgtcgttctctcgcctgtctgttctggggacggttcagcgcggagcttctgcactcaacttgagcgcagtttttggcttagagctcgctggggaagtgcagggagccagcgccggcagccaccatggcgtcacgcatagggttgcgcatgcagctcatg

SEQ ID NO: 192353 - DNA, 6628 bp, Homo sapiens
  Payload ID: 17988
  Gene Name: transcription factor EC
  Uniprot ID: O14948
  ENST ID: ENST00000265440
  CDS Start-End: 182-1225
gtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgtt

SEQ ID NO: 192354 - DNA, 6605 bp, Homo sapiens
  Payload ID: 17988
  Gene Name: transcription factor EC
  Uniprot ID: O14948
  ENST ID: ENST00000320239
  CDS Start-End: 254-1210
acttctcttttctctttcctcaactaactggattccaaccagcccaaagtattcattactcacggctagatcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattat

SEQ ID NO: 192355 - DNA, 2704 bp, Homo sapiens
  Payload ID: 17988
  Gene Name: transcription factor EC
  Uniprot ID: O14948
  ENST ID: ENST00000393485
  CDS Start-End: 185-778
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggtttttataagaatgtagccatgagtcacatagcttacacatgactcagctgtcatcagttttcttcattggtctcatttattttttctcttattaacaattatttttccttttgaaggataattttactgctttttagaagttcgtgaattgggttgtttcaattaggatttgactagaaatccaggatcaagatggctgaatatgtatatatgtatatatgtatatacacatatatgtgtatatatgtgtgtatgtgtgcatgtatatatatatacacatatataatgacaacaaattacaaaatgcataaaatataactcatttcataaatgcacacattattatcctaatcaaataataatactaagtaaaacatttgtttctctacattatattggacattaaattctcccctccttctttcatttctttccaacattgctatggatttcattgcctcaaggcatgttgtgacagtgtatattaagtcacttctcatctgttcatataatccaaaatatcaaaatatgggcttttataactctcaagattttttaaaaatgtgagtatgcttagcaccaggtaaaacatttactgtttccatgaaaaggtcctgcatttacagtgagaaattaatcaggaagaataaatagatgactttctgctatctccaaatggctatattgtagtctgagccactatggaaccatcatcagtcataacctttgtagaacaatgagaccaaacttaaaaaaaagtctgagtaattttctcagagttatttttcatgcatcagaaatgtatcaatttcattatttgcaaagattattcataatttgtattgtattactcttcattttaaatgcttgttaatattttgattctatgtctggcttattctctagtgttaaatccaatttcaaagacattatttaatgattttcgtttgaaattacaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaa

SEQ ID NO: 192356 - DNA, 6309 bp, Homo sapiens
  Payload ID: 17988
  Gene Name: transcription factor EC
  Uniprot ID: O14948
  ENST ID: ENST00000457268
  CDS Start-End: 64-906
ctttagtgtagaagtttccacacagttctcttggttattgtttgcaagtttaaggaaaagaaaatgatgaaggagaaagagaaaaccattgctattgtgaaggttatagacacttcaaagttaaaactgttatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgtt

SEQ ID NO: 192357 - DNA, 1245 bp, Homo sapiens
  Payload ID: 17988
  Gene Name: transcription factor EC
  ENST ID: ENST00000484212
  CDS Start-End: 176-1126
gaaaaagaggagaagtgggagtaaacagaaagataatgcttatggtacatacaaaacaaatggagagattgagtctcacggattcttcgcctgagccaccagcaaagagtcctatcaatgatttagttccctagagaaaatcagaaagtaaaagtgagaagaaaagaagagaaatatgttacaagctttaactggacttcaatttcagctgaaagaacaattaggagaaaaggagagaagacttcaaatcagccaggaaatcagtgcccatagaacagagttccacatgcagttttcatacaaaccagtgttgcatagacttgtcccagcaagaccacaaatttattcaagtcaattaccatcctttaccagggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggtttttataagaatgtagccatgagtcacatagcttacacatgactcagctgtcatcagttttcttcattggtctcatttattttttctcttattaacaattatttttccttttgaaggataattttactgcttttt

SEQ ID NO: 192358 - DNA, 2453 bp, Homo sapiens
  Payload ID: 17989
  Gene Name: transcription factor-like 5 (basic helix-loop-helix)
  ENST ID: ENST00000217162
  CDS Start-End: 238-1689
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggttctaagcacaaactccagatacgtcatgttatggacttgcttcctgaagatgaaatcagcagttgatggaaagaatccacaacacgcctacagaacagcaaatcacaaatggctgtgtctccacgaagccaggagctttgcatttgaagtttctatctgggctcatttccagctgttcagggttcggattcctgaaggcttccttagcatttaactcattctttgttgactgaaggcactggcactgtttctccacacgcaaactgatctttgtcataaatcacttttataatgagagagcagcctggacacattgccacaccttccccattctccagctcttccttggtgatggagaagttatctccgcatgggcagggacagaaatatgtctccgagtcctcgtcatattggaagtcctcgatttccacctcgtcatgaaatactgccatggtcagcgggggttgctgaaggggtgacgccccagcagtccgagaccagctccgagggtctaacttctccggagccggcccaggctctgactttcatttaattgtcctgaaaggtgaattctatcttgccaaataggcaagtgttttttatatgtaggctttaggtgtcagaatataggaaattatcaaaatgtggggtcattttaaattgcatcctaaaaccttttaaaatttgggaagaagctgggcgtcgtagctcacgcctgtaatcccagcactttgggaagctgaggtgggcagattacctgaggtcaggagttcgagaccagcctggccaatacggtgtgacccccgtctctactaaaaatacaaaaattagccgggcgtggtggtacatgcctgtaatcccagctactcaggaggctgaggtgggagaatcagttgaacccaggaggcaaaggttgcagtgagctgagatcgtgccattgcaccccagtctgggcgacaagagtgaaactccatatcc

SEQ ID NO: 192359 - DNA, 2456 bp, Homo sapiens
  Payload ID: 17989
  Gene Name: transcription factor-like 5 (basic helix-loop-helix)
  Uniprot ID: Q9UL49
  ENST ID: ENST00000335351
  CDS Start-End: 94-1596
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgtta

SEQ ID NO: 192360 - DNA, 3052 bp, Homo sapiens
  Payload ID: 17990
  Gene Name: transcription termination factor, RNA polymerase I
  Uniprot ID: Q15361
  ENST ID: ENST00000334270
  CDS Start-End: 41-2758
gggttgggagaaaggtggcggcgctttcggagggaataaaatggaaggagaatcaagcagatttgaaatccacactccagtttctgacaagaaaaagaaaaagtgttctatacataaggaaagacctcagaaacattcccacgaaattttcagagactcctccctggtgaatgaacagtctcaaataactaggaggaaaaagaggaaaaaagatttccagcatctcatttcttctcctttgaaaaaatccagaatctgtgatgagactgcaaatgccacttccacactcaaaaagagaaaaaagagaagatatagtgctttggaggtggacgaggaagcaggtgttacagttgtccttgtggataaagaaaatattaacaacacaccaaagcattttagaaaggatgttgatgttgtttgtgttgatatgagcatagaacagaagttaccaagaaagcctaaaacagacaaatttcaggtacttgctaagtcacatgcacataaatcagaagccctgcacagtaaagttagggagaaaaagaataaaaagcatcagaggaaagctgcatcctgggagagccagcgggcaagggacaccctgcctcagtcagaatcccaccaggaggagtcctggctttctgtgggtccagggggtgaaattacagaactaccagcatctgctcataaaaacaagtctaagaaaaaaaagaaaaagtccagtaaccgggaatatgagacactggccatgcctgaaggatcgcaagcaggcagagaggccgggactgatatgcaggaatcccagcctactgtgggcttggatgatgaaactccacaactactaggacctactcacaaaaaaaagtctaagaaaaaaaagaagaaaaagtccaatcaccaggaatttgaggcattggccatgcctgaaggatcacaagtgggcagtgaggttggggctgatatgcaggaatcccggcctgctgtgggcctgcatggtgaaactgcaggaataccagcacctgcttataaaaacaagtctaagaaaaaaaagaaaaagtccaatcaccaggaatttgaggcagtggccatgcctgagagcctcgagagtgcataccctgaaggatcacaggtgggcagtgaggttgggactgtggaaggcagtacagctcttaaagggttcaaggaatccaacagtacaaagaagaagtctaagaaaaggaagcttacgtctgtcaaaagggcacgagtgtctggtgatgatttttcagtgcccagtaagaactctgagagcacactctttgattcagtagaaggtgatggcgccatgatggaagaaggtgtgaaatctaggccccgacaaaagaaaacccaggcctgtttggcaagcaagcacgtgcaagaggcgccaaggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctgctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatctactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcaaaaattagccgggtgtggtagtgcacacctgtaatttcaactacttgggaggctgaggcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggc

SEQ ID NO: 192361 - DNA, 1780 bp, Homo sapiens
  Payload ID: 17990
  Gene Name: transcription termination factor, RNA polymerase I
  ENST ID: ENST00000612514
  CDS Start-End: 241-1413
acttccgcttcctcaacagcagcacttccgggttgggagaaaggtggcggcgctttcggagggttagaacctgcaaatgaagaacacaatgtggaaacagctgaagattccgaaataagatacttatctgcagattcaggagatgccgatgattcagatgcggatttgggttctgccgtgaaacagcttcaggagttcattcctaacatcaaggacagggccaccagcacaatcaagcggatgtaccgggacgacttggaacggtttaaggaatttaaagcacaaggtgtcgctattaaatttggcaagttttctgtaaaggaaaataagcagttagagaaaaatgtggaagactttctagccctgacaggcattgagagtgcagacaagctgctgtacacggacagatatcctgaggaaaaatctgtgatcaccaacttaaaaaggagatactcgtttagattacacattggtaggaacattgcccggccctggaaacttatatactatcgagcaaagaagatgttcgatgtcaacaattacaaaggcaggtatagcgaaggagatactgagaagttaaagatgtaccattctctccttgggaatgactggaagacgattggtgagatggtggcccgaagtagcctctccgtggccctcaagttctcacagatcagcagtcaaagaaatcgtggtgcttggagtaagtctgaaacccggaaactaatcaaggctgtcgaagaagtgattctgaagaagatgtctccccaggagttaaaagaggtggattccaaactccaagaaaatcctgaaagttgcctatcaattgttcgggaaaaactctacaagggcatatcttgggtagaagtagaagctaaagtgcaaaccagaaattggatgcagtgtaaaagtaagtggacagaaattctaaccaagaggatgactaatggtcggcgtatctactatggcatgaatgccctgcgggccaaggtcagccttattgaaaggttgtatgaaataaatgtggaagatactaatgaaatagactgggaagatcttgctagtgccataggtgatgttcctccatcttacgttcaaactaaattttctaggctgaaagctgtctatgttccattttggcagaaaaagacttttccagagatcatcgactacctttatgagacgactctacctttgctgaaggaaaagttagaaaaaatgatggagaaaaaaggcactaaaatccagactcctgcagcacccaagcaagttttcccatttcgagacatcttttattatgaagacgatagtgaaggagaggacatagaaaaagaaagcgaaggccaggcgccatgcatggctcacgcctgtaattccagtactttgggaggccaaggccggtggatcatctgaggtcaggagttcgagaccggcctgaccaacatggtgaagacctgtcactattaaaaatgcaaaaattagccgggtgtggtagtgcacacctgtaatttcaactacttgggaggctgaggcaggagaattgcttgaacccaggaggtggaggttgcagtgagccaagatcgcaccaccgcatgagagagagagattactatttcttgtccctttttctcagtttgattatatttatatacatatgtcagtaaatctgttttcagtattgatgtttaataaagaatgtacaatggccagagttctactctttcctctggagcattaaaatatattgccattcctattaaaacgtatttgaatgtgaaaa

SEQ ID NO: 192362 - DNA, 9462 bp, Homo sapiens
  Payload ID: 17991
  Gene Name: transcription termination factor, RNA polymerase II
  Uniprot ID: Q9UNY4
  ENST ID: ENST00000369466
  CDS Start-End: 45-3533
agaattgggggcggggctttgtggaacttgggggacccagcgaaatggaagaagttaggtgtccagagcacgggactttctgctttcttaagaccggcgtccgcgatggcccgaataaaggaaagagcttctacgtgtgccgggcagacacgtgcagcttcgtgcgggccaccgacattcctgtttcccattgcttattgcatgaggactttgtggtagagcttcagggtttgcttctgccacaggacaagaaagaatacagattgttcttccgatgcattagaagtaaggcagaggggaaacgctggtgtggaagtattccatggcaggatcctgattccaaagaacattctgtatccaataagtctcagcatgcatctgagacatttcatcattcttccaactggctgagaaatccattcaaggtacttgacaagaatcaagaaccagctctctggaaacagctcatcaaaggtgaaggtgaggaaaagaaggctgataagaagcaaagagaaaagggagatcagcttttcgatcaaaagaaagaacagaagcctgaaatgatggagaaagacctctcatctggcctggtaccaaagaaaaaacaatctgtagttcaagagaagaagcaagaagagggagcagagattcagtgtgaggcagagactggaggcacacacaaaagagacttttctgaaattaaatctcaacagtgccaaggtaatgagcttacaagaccatctgcatcttctcaggagaaatcaagtggtaagagtcaagatgtccaaagagaatcagaacctctgagagaaaaggttacccagcttttgcctcaaaatgttcacagtcacaactcaataagcaagccccagaaagggggacccctcaacaaggagtacacgaactgggaggctaaagaaacaaaggcaaaggatggccctagcatacaggccacccagaaaagcctgcctcaggggcatttccaagagcggccggagacccacagtgtgcctgctcctggaggaccagcggctcaggctgcaccagcagcaccagggctttccctgggtgagggccgtgaagctgccacaagcagtgacgacgaggaggaagatgatgttgtttttgtttcctctaagcctgggagccccctactctttgactcgactctggacttagagacgaaggaaaacctccaattccctgatcgaagtgtgcaaagaaaggtgtctcctgcctcaggtgtttccaagaaggtagaaccctcagacccagtagcccggcgtgtctaccttacaacacaactgaaacaaaagaagagcacactggcatcagtgaacatccaggctcttccagacaagggtcagaagttgatcaaacaaatccaggagctggaggaagtactcagtggtcttaccctttccccagagcaaggaactaatgagaagagtaacagtcaagtaccacagcagagtcacttcaccaaaactaccactggccctccccacctggtgcctccccaaccccttcctcgtcgtggtacccaacctgtgggttctctagaactaaagtctgcctgccaggtgactgctggaggatccagtcagtgctatcgaggccatacaaaccaagatcacgttcatgcagtgtggaaaatcacaagtgaagccatcggtcaactgcatcgctcacttgagtcatgtcctggtgagacggttgtggcagaagatcccgccgggctgaaggtccctttgctactacaccagaagcaggcattggcttggttactatggcgagaaagtcagaagccacaaggaggaattctggcagatgatatgggcttaggaaaaaccctgacaatgattgcgctcatcctgacccagaagaatcaagagaaaaaggaagaaaaggagaaaagcacagctttgacgtggctctccaaagatgactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtcctctctacatatgacatcgtgatcactacctatagcctcgtggccaaggagattcccacaaacaagcaagaggcagagatcccaggtgcaaacctcaatgtggagggcacctcaacacctttgcttcgaatagcctgggctcgaatcatattggatgaagctcacaatgttaagaatccccgagtgcagacttccatagctgtgtgtaagctacaagcctgtgcccgttgggctgtcactggaacccccattcaaaacaacttattggatatgtattcgctgctgaagtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtgatactgccccagcgtaaatttcagttgcaccatttaaagctttctgaagatgaagagactgtttacaatgtgttttttgcaagatcaaggtcagctctgcaatcctatctaaaaagacatgaaagtagaggcaaccaatctggaagaagccctaataatccattcagtagagtggcactggagtttgggtctgaggagcctagacactcggaggcagcagactcaccgagatccagcaccgtccacatactgtcccagttgctgagactccgccagtgttgctgtcatctttctttactgaagtcggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaagatttcatctctgttggcagaattggaggcaattcaaagaaattcagcatcccaaaagagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctggtttgtattaggatctgggaataacaacctaaccatgagccttgaactctgttctttgcatttcaatttcaccgtcaagcctttcaccttcctcaaaatgaggcataatcttatccccagaattgaggaggggttgtgttaaccaattagttaaccaattatgttaataatttatttaatgagtggtatggaaaccaattgatttttttagataaaagaatatgttttagagttggatgattttggaaaacaactctggcagaattgtatataagcttcagtaaagttcaaaaagcgggccaggtgtggtggctcatgcctgtaatcccgacactttgggaggccaaggcaggaggatggcttgaagccagtagttcaagaccagcctgggcaacatagtaagaccccatctctatgaagaataaaaaaatgagctaggcgtggtagtgcacacctgtagtcctagctacttgggaggctgaggcaggaggatcccttgagtccaggaggttgaggctgcagtgagctgtgattgtgccactgttttccagcctgggcaatacagtgagaccctgtctcaaaaaaaggaaaaaaaagctcaaaaagttctgtgttgcctttctcttcttagctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgcaggcagttcttcctctcaggctgaagatcaaggagatgctttgtacatgaacagatgctgagtatctgttatcattgtattgtttagtgtcagtgtatcatttagtatttgtatcactgtaccatttagtgttgtatatcactcagtcatttaatattggttatcaccatacagtttaatatttgtatcatttggttcattgtatcgtttagtatttctattataacatttctatttgtagtatttgtataatatttgtgtcatttttaatagtatttgtatttttacaaatttgcagtatttgtagcatttagtatcattgtttcatttagtatttggtacaatctaataaatactaatccagtccaatactaatccaatccaatactaataatactattggtacaatccaatactaataatactattggtacaatccaatactaataatactaacagtagtattgatacaatctaataaataatgtgtttgacagtgtagcagaaataatgctatgtgttcaccaaacccacttccttttcctcccgggcacccagagagactgtatttcccagtttttgctgcagtttgacggggtccatatcaatggactgtggagagaagcgattgatgtaagtcacttctaggtggccctctaccactttccaaaagatcattcatgctgtttcttccctcctcagcctatgggatgcaaaggaactgatggaagattacaaggccctagggaaggtgaagccactagctcagcagttcttagcctagtttttggccatcagcccttctattagactagtgaagcctcagtcccaggatggctccccatgtacacttccctcctcgccccagctcacctacactggactatgacatgatcaaggaatctttttttttaagctactgagatttctgtgttgtttacatagcagtttgtaccctaaacaaacacttgagattttatacttcaggaaactattcagatttccttctcattagcaattgttccaaaaacacttactctgctaatttctgctagaaagaatcacagttcttctaacacagaaacatttctgtcccttgagttgggaaacaagaccctatgttaacccagtcagagtgtggactgaggcattcggagcctatttaagcagaagttttctataaggacaagatttaaaggcttacaaaggtaaagacaatggcctggtgggaagaattctagtctagaacgtttgagatttgactctagttctaggttcatcttagctgggtgtgtaacgttgaaaaaattggccgggtgcagtggctcaggcctgtcatcccagcactttgggaggccgaggcagacggatcacgaggtcaagagatcaagaccatcttggccaacatggtgaaaccccgtctctactaaaaatacaaaaattagctgagcgtggtggcgtgcgcctgtagtcccagctactggggaggataaggcaggagaatcgcttgaacctgggaggtggaggttgcagtgagctgagatcgcgccattgcactccagcctggtgacagagcgagactccgtctcaaaaaaaaaaaaaaaaaaaaagagagagaaaaaaatccttactttctctacactctgatttcctcatttgtaaggtgggcagttttcagaacttagcagcaataaggtttctgataaaatcaagaagcaaaggaagtaacattgcctttttgaagttttgctataagattgacataccaaggtaaagattgagtcacctgagaagcagtggctcccaggccagcaagaatgtacaaacctggctctgccatttgctgattgatattaggcaagttgcagattccttggacatctcaatcctttcatctgtaaaatgtgtggattagcatgtatctcatgctccactgggaatttcatagcaaatatatatactacaacatggttgaccagatagatcagtaatgtcaactagaaggtattagatgaacattgtcagtctccaatcaagcattgtttaggggagaggaattctttcaggttcaagcattctggcttttagtttggagagggatgcagggattgtaacttaaaatcttcagatattgaggccattgacaagtaatctactgtaaggtagatgcctcctggtattttaaaacagcttttctaatttctcatgttattgtacataagcaaagcaacctagttatgtcttgggtaggtgttcttatagccgtgagatgctactgacttgaggtggatgcagaaaaaaatggaaccactgccttaatgggatggaatatactaaacatgcattcttaaatcctagtgctgggatggattacatgaattacattgtggagctgcatatgtgtctcccctcttccctccctgggggttaggctgggtttgtttggttttttttgttttgtcctcatgaggcttagcatctaagggagacaggcatgaattaacagaagtggcattctggtatctgtctcagcctcatattcattttagtgtaaatcagtttcgtcaagtctaggtatgacaaggtgggtctttgcaccttctagcgatgggcagcatcccacaacacagtggtctaattgaggtgctgcactatgagtcctgcctgtgttaaccagccttccttcatgtcacaatactgctgctggatttgctttttacatctgcctattgcacctgacttgggcatggatgatatgaggtaataaatgctttgaaaaccatgaagggccacacaagtgctagtgttattgctgtgggacaaggtctgggaatatgagaaccagcagcagcatgggtgcagctgagaaccagatggtgaacatctgtctccaaagtgcaacattcctgagcaccggatttataaggcatttcttactcgacagaattgacttcatggaaggtatgtagtttgactttgccttagccatgttgatcaaataggagtattgtgcatgccgcagctagacagagtcctgggccctttaaaaaccttgtcagtgactcccattgcaggcccagcgcagtggttcacacctgtaatcccagcatttgggaggctgaggcaggcagatcacttgaggccaagagttcgagaccagactggccaacatggcaaaacctcctctctactaaaaatacaaaagttagccaggcgtgatgttgggtgcctgtaattgcagctactcgggaggctgaggcaggagaatcacttgaatccaggaggcggaggttacagtgagctgagatcataccactgcactccagcctgggccacagagaaagaacggtgattctttctagcagaaattagcagagtaagtgtttttggaacaattgctaatgaaaagaaggaaaaacagaaaaaaaaaattttctgtttatgggaggtgacttatttctctatcaatcctgtgagtgatttagcatggcaattcatgaacactgagttgtttccttgctctgattgtctgttgctcaatgaaatggcttttagcagggctcaaaggtgaagccagattctcctgcactaataggataagcatggagacaccagtgttcagtgtggcctctggttgtctgaaattttgctgtcaactctaataccttgaaagaattaggtttccaaagtgggatattgtgctgctgtttgtgatatagcatctagacttaggaaagggcaggaacaatttaaaagcacatctgtaggcacaaagagaattataatagaaattcagaattcctaggcatatgacctagactaaaatgtcttcataactacaaatgaaatcagggtcatttatagtacaaactaccacagaagtcagtagttaggggatggagatagatatgaaaaaaaaaaaaagcaaacccagcctaactcccagggagggaagaggggcgacagatatgcagctacacaatgtttttactatcttgagttctttttacccagattccatagctaaatccagatgtattaataggtagagactacttcagaaaggatgagactattttcttgcttaattatccacacagtaattcagaaatgtatattgaacactttttatatgccaggcactgctgggcactggaaatataaaagtaagcaaaaatgaaaaactatcctgtcctcctgaggcttagcatctaagggagacaggcattagtcaaccccgtgtggctgtgaatcagccatgatgctgagtgctacaagagaggactgtgcggctgggagggcttataacaggatttgacctagttagggaagatctgaggaagtgatgaaagaatggaaatcaatatgtaagagctcacaagtcagagtgagatgtttcttcctatactgcctgcttctaatgagcatccacttcattgaaccacctcttcattgagccaaacctaccatacagggatacattctctggaggaaagttgagcaactattgcatttgggacattagagtatgggtgggctgacaggtatgtgtatgtttattatccaagacagccaaggtgtttatcctgttacaacatcccagaggacagaggctcttatttgtgactcttttttcttacctgtaacaccagaggcataacgtacatcataatgctgcatcttgttgacgcttcaatgctcacaattcaaaggtgatttctgaagcactttgttacactggggacagctcctaaatcctcccactctttttttgcctcaccttggagtcttgggctctgttgatcactgactctgccaggtctttcagcaggcaagacagctcagttaaattgagtttggactccactgtagtgcatgcatgagacagcacccccaatccccaacacccacacacaaactttaaatatttgtaacagaattgttaccattaatattgcttaaaggctaacacattagccagaacctagatgtcttctggaaattttttattgcaatgttacttcatctacataaagttgtccaatcactgaaacctccaactgaaataaatggtaagctttttgttctcaa

SEQ ID NO: 192363 - DNA, 639 bp, Homo sapiens
  Payload ID: 17991
  Gene Name: transcription termination factor, RNA polymerase II
  ENST ID: ENST00000427271
  CDS Start-End: 1-432
aacatgctgaaagttgtagcattgcacctgaagaagcatggactgacttatgccaccatcgatggctctgtcaatcccaagcagagaatggacttggtagaggcatttaaccactccagaggccctcaggtaatgctaatctctctcttggccggaggtgttggtctaaacctgactggaggaaatcacctctttcttttggacatgcactggaatccatcacttgaagatcaagcttgtgaccgaatttaccgagtagggcagcagaaagatgttgtcatacacagatttgtttgtgagggaacagtagaagaaaagatcttacagctccaagaaaaaaagaaagatttggccaaacaagttctatcagggtctggagaatctgtcaccaagctcaccttggctgacctcagagtcctttttggcatctaacctcctgtggataagggctcagaatagcaccattgctgctgatgatgggagaaccagttactaccttctctaacacaggctccatcctatctcttcatctcttcttgccagtgatgttgcacctgtaaccatctttttatgggtggagcagagagtcaatccctgcagccaccctgcagccagccatctctgcagttctctcagtgc

SEQ ID NO: 192364 - DNA, 2159 bp, Homo sapiens
  Payload ID: 17992
  Gene Name: transcriptional adaptor 1
  Uniprot ID: Q96BN2
  ENST ID: ENST00000367874
  CDS Start-End: 95-1102
agcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaaacaatactgggctaacctaaagctgtggttcaagcagaagatcagcaaagaggagtttgaccttgaagctcatagacttctcacacaggataatgtccattctcacaatgatttcctcctggccattctcacgcgttgtcagattttggtttctacaccagatggtgctggatctttgccttggccagggggttccgcagcaaaacctggaaaacccaagggaaagaaaaagctttcttctgttcgtcagaaatttgatcatagattccagcctcaaaatcctctctcaggagcccagcaatttgtggcaaaggatccccaagatgatgacgacttgaaactttgttcccacacaatgatgcttcccactcgaggccagcttgaagggagaatgatagtgactgcttatgagcatgggctggacaatgtcaccgaggaggctgtttcagctgttgtctatgctgtggagaatcaccttaaagatatactgacgtcagttgtgtcaagaaggaaagcttatcggttacgagatggtcattttaaatatgcctttggcagtaacgtgaccccgcagccatacctgaagaatagtgtagtagcttacaacaacttaatagaaagccctccagcttttactgctccctgtgctggtcagaatccagcttctcacccaccccctgatgatgctgagcagcaggctgcactcctgctggcatgctccggagacactctacctgcatctttgcctccggtgaacatgtacgatctttttgaagctttgcaggtgcacagggaagtcatccctacacatactgtctatgctcttaacattgaaaggatcatcacgaaactctggcatccaaatcatgaagagctgcagcaagacaaagttcaccgccagcgcttggcagccaaggaggggcttttgctgtgctaaattaggatttgagggtgtgggaccctcaccgaattcattgattactgaaaattgaatgttttttgggtccacatttcaaggctgaagtgtatagtgtatatataacctttcctatggaaatgtgacattgagtacattttgtgttgctgttgtgaagccattaatataaatctttggtaatgacccatatctctatatgtatgtgttcccagttgtgggagcaggcactaatgaaatcctgtgcctggaatggagatatttaggtacctgaggcttagtgtcctgtggtctgcatgtaagatagatgacatcctagaacaaagaagctgttttaacttaatccccctgatcagcaggatatctgtgtgttcagtgacatcatacattctgtatctagaagtctaaaatttctgcctttctcctaaagaatgtgttcttgcattttggttgaaataacctacacagtgttaaaaatcagatacctcctttagtgaccagttcaaattttaatagcgataggtagcccctgagaaatttatcactataactccacaggaaatatgacttggaagtgctctgtgtactaaacaaaataaagcccctctttgcatttaaaaccaaagtcaaaacaaaactcttgtaatgcaattaattaactttatgtcttcccatgactcaagttttgttaaatatgcccaaaaactttgattggcagtttcttcggttaattattcctatagaatgtattttaagaaatctatacaaattggatatatgcttggtaattctccagtttctaggaggtacctatttctaccgtttcaagtgatgaagtgaaaataatttacattcgatagtgttactgataacaaacctacttaagagatatgttgctttttacttaagggatagtgttgatagataaattagaatgtatagataggtttgtgaaagtctaaataatggttgtatagatatgtatatatggttcacatatctggatctgtgtatttgattttgtactttaaatgtgacaaataaaccttttgggagaaaa

SEQ ID NO: 192365 - DNA, 1948 bp, Homo sapiens
  Payload ID: 17993
  Gene Name: transcriptional adaptor 2A
  ENST ID: ENST00000612272
  CDS Start-End: 371-1702
atttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggca

SEQ ID NO: 192366 - DNA, 804 bp, Homo sapiens
  Payload ID: 17993
  Gene Name: transcriptional adaptor 2A
  ENST ID: ENST00000615328
  CDS Start-End: 222-804
agcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcat

SEQ ID NO: 192367 - DNA, 2211 bp, Homo sapiens
  Payload ID: 17993
  Gene Name: transcriptional adaptor 2A
  ENST ID: ENST00000620628
  CDS Start-End: 158-1489
aaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaa

SEQ ID NO: 192368 - DNA, 561 bp, Homo sapiens
  Payload ID: 17993
  Gene Name: transcriptional adaptor 2A
  ENST ID: ENST00000614112
  CDS Start-End: 162-561
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatgg

SEQ ID NO: 192369 - DNA, 1043 bp, Homo sapiens
  Payload ID: 17993
  Gene Name: transcriptional adaptor 2A
  ENST ID: ENST00000620367
  CDS Start-End: 109-1026
gtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctc

SEQ ID NO: 192370 - DNA, 4253 bp, Homo sapiens
  Payload ID: 17993
  Gene Name: transcriptional adaptor 2A
  ENST ID: ENST00000615182
  CDS Start-End: 174-1505
ccgggggcgcgcacgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcacctgtaatcccagcactttgggaggctaaggtgggcggatcacgaagtcaggagttcaagaccagcctgaccaacatggtgaaacagtctctactaaaaatacaaaaattagctgagtgtggtggcacacgcctgtaatcccagctactcaggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttgtgggtgtgtcaaatattctggtaactgaaacacacttaaggtgttggatgcctgccccatcacgctgcactgtctgctgtcacatgtgtcctgaactcaccctgtttttgccctgggtttcccaggataccaagcccctgaggatggagatgatgcaacaaacctcagctttgcttggattgtgacttgaaccctatttctcaatggtgaaaggctagcctgcaataaaagctgcttttaaaacagaagtaaagcagctttatatatgggactcactagatatgagggtaagtagccccaccacatgtaaaacttggtcctcaaacgtttctgcagaataagaagccaaacttatggttatcttgtttctgttagaaacaaagttgtatatagaaataacttcgtcagaatcgacacaaatcacatcgaatagttgactgtttaattccttctacattcaaatatctaattaaaatactgtgtgctttgttggaagcatctgctcaaacttttgactgttgtaaatatgcatgcagctgggaagggattcatctaagggataagaaatgaaaaagacactctaaggacctgagggaattcaaatagaggacttcgattttttaaaaagaatgacgtggaaatgacctgttttccttgtaaaatcatatctcgtagaaaacattttaccactaccatcacccctagttggttgtgaagtgattgcctcttatccctgaaaggaaactcctgttctgaaaagttgggatgcattagccatcagtgttaggtgacgtctgttgtagtctgaagagtccttaaccttgattaaggaaggcttcctgggagaggtgggcttttggggcaattatatgatagagaagagagagaaaaatggcagatggaagtgggagacaattccacacacagggggtggagaatgatgtggaggcagcagtgggtgtaaggacaatggtgccaagagatttatttggctagaacacaaggggcagctgggtagttaggagtgggaggatggtaggacagtctgacagaaaccttggaaacagttgaactctgaaaagctgatggcaaatcagatttcatgaggaaaatggcatggttgaaaatagtaatagaaaaataagactgaagttttaaatgactggatttttgaaagtaggattattatttctttggtataccgaactttgcaaagatacgtagcattgcatccttcctctttgcttctagacagggttggccataaaccaactacactgatagaggtctctccagattgtctcagaagagagagtttaccctgaaacttaatgacatgaataaaacctgtttactgaaatttttattgcaatttaacgttaaaagtttctgctggagttttatgcatatttttctctctaagtggtgggaaataaagaacaaatctctttccatgtaa

SEQ ID NO: 192371 - DNA, 1948 bp, Homo sapiens
  Payload ID: 17993
  Gene Name: transcriptional adaptor 2A
  Uniprot ID: O75478
  ENST ID: ENST00000622522
  CDS Start-End: 371-1702
atttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggca

SEQ ID NO: 192372 - DNA, 920 bp, Homo sapiens
  Payload ID: 17993
  Gene Name: transcriptional adaptor 2A
  ENST ID: ENST00000619777
  CDS Start-End: 1-253
gacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactgaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgct

SEQ ID NO: 192373 - DNA, 2211 bp, Homo sapiens
  Payload ID: 17993
  Gene Name: transcriptional adaptor 2A
  Uniprot ID: O75478
  ENST ID: ENST00000617828
  CDS Start-End: 158-1489
aaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaa

SEQ ID NO: 192374 - DNA, 1003 bp, Homo sapiens
  Payload ID: 17993
  Gene Name: transcriptional adaptor 2A
  ENST ID: ENST00000614122
  CDS Start-End: 158-445
aaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggtaagagcttggtgttaagagttgtcctgccctagtggactcagagaagaagctgttgttgaagagtaaaggaaggaacctcaggaagagaaagcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtat

SEQ ID NO: 192375 - DNA, 598 bp, Homo sapiens
  Payload ID: 17993
  Gene Name: transcriptional adaptor 2A
  ENST ID: ENST00000621780
  CDS Start-End: 429-598
gtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggttcctttagcatgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaa

SEQ ID NO: 192376 - DNA, 920 bp, Homo sapiens; identical to SEQ ID NO: 192372
  Payload ID: 17993
  Gene Name: transcriptional adaptor 2A
  ENST ID: ENST00000632804
  CDS Start-End: 1-253

SEQ ID NO: 192377 - DNA, 1043 bp, Homo sapiens
  Payload ID: 17993
  Gene Name: transcriptional adaptor 2A
  Uniprot ID: O75478
  ENST ID: ENST00000633584
  CDS Start-End: 109-1026
gtctcggcgagggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcatgtaggtggtttttgagccttgagcagtatttgtgtgtgtatatttatataaataggagagataatggtgtgttttatgtgaagttctataaataaataaatggatatttctc

SEQ ID NO: 192378 - DNA, 4253 bp, Homo sapiens
  Payload ID: 17993
  Gene Name: transcriptional adaptor 2A
  Uniprot ID: O75478
  ENST ID: ENST00000633468
  CDS Start-End: 174-1505
ccgggggcgcgcacgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaagttgtattgtctactttcttctccatcctgctttaaaacactcctgttgttggtattatgctgcagagttgtgtgctacataagctattattaaatgtgagtgggcattcattcctaacacctcttgtaactaaaagaaccatagtacctcacatcacagtgctggtagaaatggaactaaaccacagtctgtaatcccaggagtccagctcagatccttatattgcgaggtaagtttgctgattatctgtcttgccttcaaacactgcagacagatttaaaataaagagaaaggttttagagcataagaaagctctcgttgaaggattttttaagctgacaactttttttttttttttttgagacagagtttgctcttgtcctccaggctggagtgtgatggcaagatctcagctcactacaacctctgcctcccaggttcaagtgattctcctgcctcagcctcccgaatagctgggactacaggtgtccaccaccacacctggctaattttgtatttttagtagagacagggttttgtcatgttggccaggctggtcacaaactcctgacctcaggtgatctgcccgcctcagcctcccaaagtactaggattacaggcgtgagccatcgcgcccggcctaagctgacaacttttatgagtaaaggggaagaaaatatccttatgatggtcttatcccaaactgcatctttaacttcggccgggcaaggtggctcacctgtaatcccagcactttgggaggctaaggtgggcggatcacgaagtcaggagttcaagaccagcctgaccaacatggtgaaacagtctctactaaaaatacaaaaattagctgagtgtggtggcacacgcctgtaatcccagctactcaggaggctgaggcaggagaattgcttgaacacaggaggcagaggttgcagcgagctgagatcacgccactgtgctccagcctgggcaacaaagtgagactctgtctcaaaaaaaaaaaaacaaaaaaaaacctttaatgtctggctttgtactttgcagtctgcctgtctaatctgcagtagtcttttgaggaggtggcaccggatataacatgtctctgttatttttagaattaattaaaatgttttgctatttaatttgtgggtgtgtcaaatattctggtaactgaaacacacttaaggtgttggatgcctgccccatcacgctgcactgtctgctgtcacatgtgtcctgaactcaccctgtttttgccctgggtttcccaggataccaagcccctgaggatggagatgatgcaacaaacctcagctttgcttggattgtgacttgaaccctatttctcaatggtgaaaggctagcctgcaataaaagctgcttttaaaacagaagtaaagcagctttatatatgggactcactagatatgagggtaagtagccccaccacatgtaaaacttggtcctcaaacgtttctgcagaataagaagccaaacttatggttatcttgtttctgttagaaacaaagttgtatatagaaataacttcgtcagaatcgacacaaatcacatcgaatagttgactgtttaattccttctacattcaaatatctaattaaaatactgtgtgctttgttggaagcatctgctcaaacttttgactgttgtaaatatgcatgcagctgggaagggattcatctaagggataagaaatgaaaaagacactctaaggacctgagggaattcaaatagaggacttcgattttttaaaaagaatgacgtggaaatgacctgttttccttgtaaaatcatatctcgtagaaaacattttaccactaccatcacccctagttggttgtgaagtgattgcctcttatccctgaaaggaaactcctgttctgaaaagttgggatgcattagccatcagtgttaggtgacgtctgttgtagtctgaagagtccttaaccttgattaaggaaggcttcctgggagaggtgggcttttggggcaattatatgatagagaagagagagaaaaatggcagatggaagtgggagacaattccacacacagggggtggagaatgatgtggaggcagcagtgggtgtaaggacaatggtgccaagagatttatttggctagaacacaaggggcagctgggtagttaggagtgggaggatggtaggacagtctgacagaaaccttggaaacagttgaactctgaaaagctgatggcaaatcagatttcatgaggaaaatggcatggttgaaaatagtaatagaaaaataagactgaagttttaaatgactggatttttgaaagtaggattattatttctttggtataccgaactttgcaaagatacgtagcattgcatccttcctctttgcttctagacagggttggccataaaccaactacactgatagaggtctctccagattgtctcagaagagagagtttaccctgaaacttaatgacatgaataaaacctgtttactgaaatttttattgcaatttaacgttaaaagtttctgctggagttttatgcatatttttctctctaagtggtgggaaataaagaacaaatctctttccatgtaa

SEQ ID NO: 192379 - DNA, 1003 bp, Homo sapiens
  Payload ID: 17993
  Gene Name: transcriptional adaptor 2A
  ENST ID: ENST00000631413
  CDS Start-End: 158-445
aaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggtaagagcttggtgttaagagttgtcctgccctagtggactcagagaagaagctgttgttgaagagtaaaggaaggaacctcaggaagagaaagcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtat

SEQ ID NO: 192380 - DNA, 804 bp, Homo sapiens; identical to SEQ ID NO: 192366
  Payload ID: 17993
  Gene Name: transcriptional adaptor 2A
  ENST ID: ENST00000632146
  CDS Start-End: 222-804

SEQ ID NO: 192381 - DNA, 561 bp, Homo sapiens
  Payload ID: 17993
  Gene Name: transcriptional adaptor 2A
  ENST ID: ENST00000632354
  CDS Start-End: 162-561
acgcaaagcccggaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatgg

SEQ ID NO: 192382 - DNA, 598 bp, Homo sapiens
  Payload ID: 17993
  Gene Name: transcriptional adaptor 2A
  ENST ID: ENST00000632358
  CDS Start-End: 429-598
gtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggtccctttagcatgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaa

SEQ ID NO: 192383 - DNA, 4350 bp, Homo sapiens
  Payload ID: 17994
  Gene Name: transcriptional adaptor 2B
  Uniprot ID: Q86TJ2
  ENST ID: ENST00000310074
  CDS Start-End: 190-1452
aggggggacgcggcccggctggctggctctggcggcggctgggctggggccgcggtggcggcagccgcggcggcgggcggcggttgctcgtgcgcggcggcggcggcgggtcccgcgggcggcggggcgctgacggccgggggcgcggcggctgcggcgggccgggcggcgggcggcgagcgggggaagatggcggagctggggaagaagtactgcgtgtactgcctggccgaggtgagcccgctgcgcttccgctgcaccgagtgccaggacatcgagctgtgccccgagtgcttctcggccggcgccgagatcggccaccaccgccgctaccacggctaccagctggtggacggcgggcgcttcacgctctgggggcccgaggccgagggcggctggaccagtcgcgaggagcagctgctgctggacgccatcgagcagttcggcttcggaaactgggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaagctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttagttgtaaactatactgcatgctgacagagaagcgctcttttagctaagcccagaacttctcttttgacaataaagtactgagcagtggtatcatgagggccacctccacattgtcccctgcagaataaatgcggatgacagaaagcttatgctgtctaccactgaacagtgatggagatggtgctaagtttttacagttgtcttagccccagtggttctcaaggtggggctcctggcccagcagcagcaacttgtttgttagaatgcagacgcgcaggccccacctggcctcctgaatcaaaatggtgtgcggcagggtgcagcgagctgttttcacgaggcctccaggtgactggatgtaagcttgcttgagaactatgggttttagctattctggtgtctccctgattttctacagcgccaggatcctagtttggtgaggttttaaatttaatcttatttttatataaaatgattgccagacgtactatattaagcttgaagaagcagaagatccctgttaatgtgtatggcccaggccaagagctgtcaaatgaaaaactttgtgctgaagcaggtttttagtatgtatatctttttgatggtatgaagaatttatttaggcttgactgttttaaaacaccataatgaatgtataattaatttatgttaaagtattaaccctttgtcacaaaggaatggtaatgtgattggctgcctgttagcccatcgactattcccgtcacggtagtccttacctctgtcggcagctcagagcctccacatttttatatttaattctcatgataaattagccaccataatcccatggaattaggtcttgttaaaatctagtccgggcgcagtggctcacgcctgtaatcccagcactttgggaggccaaggcgggctgatcacgaggtcaagagatcgagaccatcctggccaacatggtgaaaccctgtctctactaaaaatacaaaaattagctgggtgtggtggtgcatgcctgtagtcccagctacttgggaggctgaggtaggagaattgcttgaacctgggaggcggaggttgcggtgagctgagatcacgccactacactccagcctggtgacagagcaagactccatctcaaaaaaaatctaagcaaactatctttgagtcaaaaaaagttggataactcatctatatttgaaataatgctgtctgaatggccaacatcccaagaatgtattaaaaacagcaaccctgcctaccgttttgatgacctttttccatattaaacaagttgagaacaaaa

SEQ ID NO: 192384 - DNA, 558 bp, Homo sapiens
  Payload ID: 17994
  Gene Name: transcriptional adaptor 2B
  ENST ID: ENST00000506692
  CDS Start-End: 195-558
atccgacagctgcccatggcctgcatcaccacctgcttcttgagtgcctggaagcgtcgccactccttctccaccctggtgagcttctcctggcactgccgcttcaactggcccagctcctggtggtaccactgcaggtcgtctgcctgctgcttcttcagctcctccagcatgcccagatggcgcaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctga

SEQ ID NO: 192385 - DNA, 3818 bp, Homo sapiens
  Payload ID: 17994
  Gene Name: transcriptional adaptor 2B
  Uniprot ID: Q86TJ2
  ENST ID: ENST00000515646
  CDS Start-End: 1245-2231
ttctcaaagaggcccacagttgagttttggcactgccttctgtagtcagagtcctggagattcctgggccccaggtggcggggggaagggtccagcacctcggctccaggcatgtgtgccagaggaagccccagctgtgggatcccatccgttcctggagcccagaacacttctctcccagacgccagctcatagtcatcagcctggatggggtggcggtccctctggtttcagctgggcctctggcagtgctgcaggcagcgctgcagtgctggttccacacccaggcgggcagaggcaggtgggggctgggtggctgagaggcggtggccagggaatgagtgcgcactttgggcagttactttctgaagtggctttagcggttgactttgaggaagaggcctctcggcagaaggaaaagattgagggagttatacagtttcctcccattaaaccttgtatttatgggttaccctcttgtaggaatgatgaatgctttcagccagtggcagactcccagccagctgcttaaccgtggaaggtgctaaaaatgaaggcctgctcccttgaagagccacaggcccatcttctgcagtcactgcctaggaaagggccacgccagcccccccggcgcatgaaggccaggatgggtgtgcggccaggacaagcgtcacagaggtgtcctggcccttgcttttccagcgggtggcaacatggtagaactgggtcccctcctgcagtgccgtggacttggcctggtctcacaccctggcacaagcccgttttctagtctgaatgaggcgagttcaggcattccttggcctgccctgctgtctcctgggacattcagacagcccctgagtgcagggtttatggcagtaccaggtgggctcctctggtcgcaggtggggaatgagaacaaagtccaaacctcagccaggggttctggcctcagctctgccaccagctcaccccaagaccttgtgccagcttgtgcctctctgggtcttcactttctcatgtacagaatcagcatgtgttgttgcttcaacattgtcatctctcccctgagcccagctcataagacagtgtgtgactgaatgcctttggggagggtgggtaacggtgctgtaggaagtactctaggtcagcctttgtaaaaacgtgaagagaatctgtgcggaacccaaatctggcaccctgatggtggaactaacttctgccctttgtcatcgtaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaagctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgt

SEQ ID NO: 192386 - DNA, 1343 bp, Homo sapiens
  Payload ID: 17994
  Gene Name: transcriptional adaptor 2B
  Uniprot ID: Q86TJ2
  ENST ID: ENST00000512388
  CDS Start-End: 46-1083
gcggcggctgcggcgggccgggcggcgggcggcgagcgggggaagatggcggagctggggaagaagtactgcgtgtactgcctggccgaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgtt

SEQ ID NO: 192387 - DNA, 544 bp, Homo sapiens
  Payload ID: 17994
  Gene Name: transcriptional adaptor 2B
  ENST ID: ENST00000510704
  CDS Start-End: 156-544
taaccgtggaaggtgctaaaaatgaaggcctgctcccttgaagagccacaggcccatcttctgcagtcactgcctaggaaagggccacgccagcccccccggcgcatgaaggccaggatgggtgtgcggccaggacaagcgtcacagaggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacat

SEQ ID NO: 192388 - DNA, 2355 bp, Homo sapiens
  Payload ID: 17995
  Gene Name: transcriptional adaptor 3
  Uniprot ID: O75528
  ENST ID: ENST00000301964
  CDS Start-End: 560-1858
cttccggttctgtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaagcatccagtctttgaatgtctgttacagtggggaggaaggaaccagtgtgggtggtaaggtttgtggggggtatgcttggtggctctcagcccatggccactaaccc

SEQ ID NO: 192389 - DNA, 2554 bp, Homo sapiens
  Payload ID: 17995
  Gene Name: transcriptional adaptor 3
  Uniprot ID: O75528
  ENST ID: ENST00000343450
  CDS Start-End: 549-1658
gtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggtgagcgttagcaggatgcacagtcccgggggtggccttggaggctgtggccacggctagtcacctttcaggggttttacaacaggctttccaatcctggctggcctctaaatcacctggagagcctcgaaaaaaacagcagtggccagtccaccgggtatgtcccaaacaaattctgattccacagagtggggctcaggcatctgtgactgaccgattgatttgatttgtttttgttttgtttttttttgagagggagtctcgcactgtcacccaggctggagtgcagtggcatgatctcggctcactgcaagctccgcctcccaggttcatgccattctcctgcctcagcctcctgagtagctgatactacaggcacccaccaccacgcccagctaatttttttgtatttttagtagagacggggtttcaccgtgttagccaggatggtctcgatctcctgacctcgtgatccacccgcctcggcctcccaaagtgccgggattacaggcgtgagccactgcgcctggcctagtttggttttttaattatggtaaaggcataatataaaatgtatctccatgggaggctgaggcaggagaatcagttgaacctgggaggcggaggttgcagtgagctgagactgcaccattgcattccagcctgggcaacaagagtgaaactgcatctcaaaaaaaaaaagaaaaaaaatttacgcttcttaaccatttttaagtgtacagtttagtagtgttacccatattcacattgttgtgtgatttattttttgtcttttcatgcttcttttctttttatccccaaagttttgttattaaaaatttgatacacacagaaaatctgaaagaatcatacaataaacatcagtatattctccaccta

SEQ ID NO: 192390 - DNA, 1617 bp, Homo sapiens
  Payload ID: 17995
  Gene Name: transcriptional adaptor 3
  Uniprot ID: O75528
  ENST ID: ENST00000440161
  CDS Start-End: 218-1516
accatctatgctccgagcggggtagagagcccttacgaacgcttgggccttccggaagttttccacctagggctgtctcggtatttttaaattcttgcactcgagtcactatttaagctcctccaggaatgggtgcagcttccctttgtgccttcggccttcttgtcacctttgccacagcctcccccagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctc

SEQ ID NO: 192391 - DNA, 873 bp, Homo sapiens
  Payload ID: 17995
  Gene Name: transcriptional adaptor 3
  ENST ID: ENST00000439043
  CDS Start-End: 588-873
aattaggacaagccgaagcggacgagcccttcgtttcttccggttctgtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctcccc

SEQ ID NO: 192392 - DNA, 4174 bp, Homo sapiens
  Payload ID: 17996
  Gene Name: transcriptional regulating factor 1
  Uniprot ID: Q96PN7
  ENST ID: ENST00000340840
  CDS Start-End: 589-3978
ctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggtcgcttctcgggagttcttggtgttggaatattttacagcaaagcagtcgaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgactgtagatgtcatgtcactccctttcttccccaggtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttggg

SEQ ID NO: 192393 - DNA, 4138 bp, Homo sapiens
  Payload ID: 17996
  Gene Name: transcriptional regulating factor 1
  Uniprot ID: Q96PN7
  ENST ID: ENST00000354325
  CDS Start-End: 589-3942
ctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggtcgcttctcgggagttcttggtgttggaatattttacagcaaagcagtcgaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttggg

SEQ ID NO: 192394 - DNA, 3914 bp, Homo sapiens
  Payload ID: 17996
  Gene Name: transcriptional regulating factor 1
  Uniprot ID: Q96PN7
  ENST ID: ENST00000372917
  CDS Start-End: 825-3695
ctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggtcgcttctcgggagttcttggtgttggaatattttacagcaaagcagtcgaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaacta

SEQ ID NO: 192395 - DNA, 7286 bp, Homo sapiens
  Payload ID: 17996
  Gene Name: transcriptional regulating factor 1
  Uniprot ID: Q96PN7
  ENST ID: ENST00000372922
  CDS Start-End: 564-4166
ggcgaggatggggagcaatgcaaagctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaggaaggagagaaggtcctgccgcctcagccccagccaccactgccgcctccgcctccgcctccgccgccaccacagctccctcccgaggcagaaagcctcacgcctatggtcatgcccgtgtctgtccctgtcaagcttctcccgcccaagcccagctctcaggggttcaccaacagcaccgttgccgccccctccgccagagacaagccagccagctcgatgtcggacgacgagatgcctgtgctcgaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcatgggggggaactggctgtgagccacagcagccccacacagacagtggtctctgaacttcaggaaagccatggacagaaaaaaaaataaaattcttttccatcattctattttcaaagaggtcttggcgttttcctacatcttttgtttagagggggaaaaaagtttcatttgctgccatttcagaaaggttatgctatcctgttttatccaagcagttgtgagtcaggaactgcctgggcagtgtgcatcaactttgtggccgaaccattacagctgtcatatccttggctgatcgtctctcccagggactactgccctccacttagtgtctgagggtaagcctagaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaaggtgcattcctt

SEQ ID NO: 192396 - DNA, 7646 bp, Homo sapiens
  Payload ID: 17996
  Gene Name: transcriptional regulating factor 1
  ENST ID: ENST00000541110
  CDS Start-End: 570-4232
ggagggggcgaggatggggagcaatgcaaagctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgttttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaggaaggagagaaggtcctgccgcctcagccccagccaccactgccgcctccgcctccgcctccgccgccaccacagctccctcccgaggcagaaagcctcacgcctatggtcatgcccgtgtctgtccctgtcaagcttctcccgcccaagcccagctctcaggggttcaccaacagcaccgttgccgccccctccgccagagacaagccagccagctcgatgtcggacgacgagatgcctgtgctcgtgaggatgaccctctctcccccacactcaccccaaggggctgccccccgcacgcctgctgaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcatgggggggaactggctgtgagccacagcagccccacacagacagtggtctctgaacttcaggaaagccatggacagaaaaaaaaataaaattcttttccatcattctattttcaaagaggtcttggcgttttcctacatcttttgtttagagggggaaaaaagtttcatttgctgccatttcagaaaggttatgctatcctgttttatccaagcagttgtgagtcaggaactgcctgggcagtgtgcatcaactttgtggccgaaccattacagctgtcatatccttggctgatcgtctctcccagggactactgccctccacttagtgtctgagggtaagcctagaagggtgctgctattgggtctatggaagcttatctatcaaaggagcaaacatccagaaaagtgtttataaagcaaatgtattgcctctgtttagagatttgcccagctgttccagttttaaacattaaaaaataaactcagttgccatggcaaaaatagaatgcacagcttacttataattttccatgcagtatagcataaggatttttgacttgaaacaaccaaagaactcctccttaacgagacagttcaaattcctgaattagtatttcttgactatcaacttaaagaatggacttcctagtacaatgttgcacttatttttttttctgaaataattctgcctgcatgtatgtgttgtgttttagcttctccccttaccccaccccaaagatcttttcttcctaatggttaatgtctcaactcggttactgtttactatcagatggtttttcattagtgaatttagacctctttgagaaagcttgtatataaaaagttaacagatatattttatggaaaaacccatcttattttcaaatatatttaactgctgttatattttattagaggaaggttgtaaatattttctaggagttctattgtaaagaaaagtatttttgaaaaaaattaatgtaataaaaaggaaaacatttttaaatagtggttgtgattgcttcctgttctggcttcgttatgttctattctcagcagatgaattgcatgccttccatatcaggatgtaatttattcaggtttgcactattataagttgacatcataatatctagtgtgcttaactgtattttcccggaatgcaagtcccttggtccatattaaagcactatgtatagcatattcataatttttcttttgtaacgtgtgtatttttaataaggattttatgtaacattttggcaacaagaggaccgtattttctagtgaattttataataacattttgctaaaaatgtttcttcctaggtcagtttttgttaaggtgaaccaaaagtcttattttaccaggggtttaaaaaaagtttgaagcttgaaagcaaagttatatttaaacatcatatgtaacaaataaataaagatgttttatagacttgtcctaaaaaggtgcattccttaaaaaaaaaaaaaagaaaaaaaaaggaaactggggcattctaggttgtttcccctccaagtgataagctttttttttttcttaattatcacaatgcttcttcaaaaagggaaccagggaaattttatttaacacattctaatcattagcctctcagaaagttattacagttcctatagatgggcattcatcaaatggagatgtaaccaaacagacactgtcatatttatttgtgaaaacctgattcaatattgcatcagctgctctgaaaataaaatattaatcttttgcgttt

SEQ ID NO: 192397 - DNA, 1467 bp, Homo sapiens
  Payload ID: 17997
  Gene Name: transducer of ERBB2, 1
  Uniprot ID: P50616
  ENST ID: ENST00000268957
  CDS Start-End: 430-1467
agtgcggttccttctaaaaaggagaggcgggagagtcagggtggagaaggcggctccaaccagattttgcgtccacaaagccaaaagcttctaggcctggcatgtacggcgggtttgtgcccgaggagcacagctggtctacacgggcccgccccgtagacaccctactcctcgactttccccttttcccagtccgagtttgacgtcggtctcctggataccaggcagccaatcgcctcgttgcgaagggaccagcgcagccaatcaggcgtcgttgctacctgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaa

SEQ ID NO: 192398 - DNA, 2229 bp, Homo sapiens
  Payload ID: 17997
  Gene Name: transducer of ERBB2, 1
  Uniprot ID: P50616
  ENST ID: ENST00000499247
  CDS Start-End: 435-1472
gaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccgcccagccgcgggtctgtggtccaagccgccccgaagcagcccgaacaagatcactcaaggtgaaggataatctactaataccagcactttgaatgaaaatttgtttctctgccacaaactgaacatcttttttttttttttttttttttggtgggggagttgaaacctaattttgtggcgtagcagctatgcagcttgaaatccaagtagcactaaattttattatttcgtatttgtacaataagcttcccaggagacgtgtcaacatttttggtgaagaacttgaaagacttcttaagaagaaatatgaagggcactggtatcctgaaaagccatacaaaggatcggggtttagatgtatacacataggggagaaagtggacccagtgattgaacaagcatccaaagagagtggtttggacattgatgatgttcgtggcaatctgccacaggatcttagtgtttggatcgacccatttgaggtttcttaccaaattggtgaaaagggaccagtgaaggtgctttacgtggatgataataatgaaaatggatgtgagttggataaggagatcaaaaacagctttaacccagaggcccaggtttttatgcccataagtgacccagcctcatcagtgtccagctctccatcgcctccttttggtcactctgctgctgtaagccctaccttcatgccccggtccactcagcctttaacctttaccactgccacttttgctgccaccaagttcggctctaccaaaatgaagaatagtggccgtagcaacaaggttgcacgtacttctcccatcaacctcggcttgaatgtgaatgacctcttgaagcagaaagccatctcttcctcaatgcactctctgtatgggcttggcttgggtagccagcagcagccacagcaacagcagcagccagcccagccgccaccgccaccaccaccaccacagcagcaacaacagcagaaaacctctgctctttctcctaatgccaaggaatttatttttcctaatatgcagggtcaaggtagtagtaccaatggaatgttcccaggtgacagcccccttaacctcagtcctctccagtacagtaatgcctttgatgtgtttgcagcctatggaggcctcaatgagaaatcttttgtagatggcttgaattttagcttaaataacatgcagtattctaaccagcaattccagcctgttatggctaactaaaaaaaagaaaatgtatcgtacaagttaaaatgcacgggcccaagggggattttttttttcacctccttgagaatttttttttttaagcttatagtaaggatacattcaagcttggttaaaaaaataataataaaacatgcatcatttttcatttgccaaccaagcacaaagttattttatactgactgtatattttaaagtatactctcagatatggcctcttacagtatttaagatatagcaaggacatggctgatttttttttataaaaattggcactaataagtgggtttattggtcttttctaattgtataatttaatttagtacaaagtttgtaaaatatcagaggatatatatatattgtttctacgacatggtattgcatttatatctttttactacagtgatctgtgacagcagcagcttcatgttgtattttttttactgaaattgtaaaatatccatcttaaagacatcaactattctaaaaattgtgtacaggatattcctttagtggtggaattaaaatgtacgaatacttgctttttcaaaaaaatgtattttctgttaaaagtttaaagatttttgctatatattatggaagaaaaatgtaatcgtaaatattaattttgtacctatattgtgcaatacttgaaaaaaacggtataaaagtattttgagtcagtgtcttacatgttaagagggactgaaatagtttatattaagtttgtattaaaattctttaaaattaaaaa

SEQ ID NO: 192399 - DNA, 4561 bp, Homo sapiens
  Payload ID: 17998
  Gene Name: transducer of ERBB2, 2
  Uniprot ID: Q14106
  ENST ID: ENST00000327492
  CDS Start-End: 708-1742
cagggaggggaagacggggagccggacgcacgaccggcgagcacagaagggcacaggagctgctccgcgagataccagcgagctgaggcgcggggctggctgggaagtagtcccggccgggccctggccccgcccctgcagggcggagggacgcatcacgcaggggtggggaagccggatccgtgcgcagggttgctaagggtgaaacttttcattgactttgctcacttcgggccggggcgcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcggtggaagatgtgcgggccaatgtgcctgaggagctgagtgtctggattgatccctttgaggtgtcctaccagattggtgagaagggagctgtgaaagtgctgtacctggatgacagtgagggttgcggtgccccagagctggacaaggagatcaagagcagcttcaaccctgacgcccaggtgttcgtgcccattggcagccaggacagctccctgtccaactccccatcgccatcctttggccagtcacccagccctaccttcattccccgctccgctcagcccatcaccttcaccaccgcctccttcgctgccaccaaatttggctccactaagatgaagaaggggggcggggcagcaagtggtgggggtgtagccagcagtggggcgggtggccagcagccaccacagcagcctcgcatggcccgctcacccaccaacagcctgctgaagcacaagagcctctctctgtctatgcattcactgaacttcatcacggccaacccggcccctcagtcccagctctcacccaatgccaaggagttcgtgtacaacggtggtggctcacccagcctcttctttgatgcggccgatggccagggcagcggcaccccaggcccgtttggaggcagtggggctggcacctgcaacagcagcagctttgacatggcccaggtatttggaggtggtgccaacagcctcttcctggagaagacaccctttgtggaaggcctcagctacaacctgaacaccatgcagtatcccagccagcagttccagcccgtggtgctggccaactgaccatctacctgcccgtggggccaggagcacccaagaccacagaaaagagaaaggaaaggccaaaaaaaagaggaaaagaaaaatgtacaaaaagattttcgatcttctcactcttacttctagaaaaaagatccagcccaggcacggaatgggagggccctgcaaagcacccaagtgtgtttcactcaccccttaccgctcgcccaccggcctgtgatttatttggttggtttgggttttatatttctttttcttttttttttttcttacatgtagttttctatataacatctttaatgagtggcttcctgtgctaagaatggtccagatgtgaactgctgctccctgctcctcccttcctccttcacactcctagtttaggattgatgtgtccaagctcatagggaagaaagagctgcagctggagcctgaccctccctggaacagggagaggctggcccgtgtcactgcctctgtcacccagctatcctcgcactcaaagccatccaacctcagcaggccttctcgggccctgccacctgaataggtctgaccccagtccccactccctttcaggctgggccacagggagttgctggctggccacttgacaccctccccctggagctgatgtctgtgactacagggagattagcacttcgtctagtgaaactcctttcatctctgtcctatggccccaccccaccattccctctaggcccagaccatcatcatggccctggccattgatgtgtatgggctttctttccctcatgcagccccttcttccccaggctggatgttgtgggtagggaggggtgtgtgtgtgtgtatttggtttgctgtccttttttaaaggattccaagccatgtgaaacttcccttctggatgtgattctgggtcgcaagtccttatttatatgtgaggctggggaatgggctgggggtattggcagtccttttgcagggcagtgtgtgtggtggggtgacaccgctgtggcttagcccaagacactcccagaggaaaacactgcagaaggaactggtttgcagactgtggaaggatctgcagttttgtttttgaccaaaaaaataataataagttagctctgaagggcagagggaatacccaagcccctgatgcctatgagaagtccctggacttcaaccctcctgttgtttggccttagcccagagggagctgctcacctgagcacccttgggggtgggcagagaggcagggtgggattttagagttagtgtctgtgcgggggcagccctgagcctggagttgagactttggggtctcttagtttggaggtgttgagtgcatttgtgcccctgcctggttgagagcttcttggtacctcttgccaccccttctcactgccctgacccaaccccactggaccttgatgctgcgaggagtggtgtcctgacggactcagcactcccgcctgatgtattggatcataggagagcacttgctctcctgcctctgccaggagagggcttgttcctccaactctaggaggccaggcaagcatggacaggagccaagggagcagggtcattaactttttcttctttgcaaagtgggcacttggcatcagggtcccaatcaccagaaagcaccaaagcccctggcaccccacccactccatcctacccagggaccccaagtaggcaactgttatggcagtgggtccagcccaggccagcactgccagcctcctctccctgcagtaggcaccagctctacctcccccggcaggcaatgtcctggcttctcagcccagcaccatctgttcccctagacttctcaggggccagcccagtctgggccaccctttgtttccctcatcctcggctcccacacaggtgacagacccagcagatagcttctctctgggaaaggttggatgctgccttacatccccttctagccctcctcccatccacacacacaggcacccacccacaccaggtcggcttgtttctcacatgtagggagagaggggagaccaacccctttgtgtcttttgaaatacgaagaaaaatgtgtgttcaggagcatgactccagtgctgcgctcttgggcccagttcagtctgtcttgtctcaaatctaggcatttttgcttcaattttattttttttaagaatacaaaaacagaaatctgcactaatttacctggtttcgtaggaaaacttttttttattttttacattttttggtgtccgtttgtattgaataatttgctacatttgtaaaatgtaagaggtatataatatatgtatatttctaacgtaaaaaacataatttttttcttttcaagattttttcttaaaaagatgagagaaacatattttttcaggaaaaacaaactttaaaaaaaaaagaggagaaataaaaccttttctcccctttccccatcctctatctatccctctttcccaggaacaaatcaaaaggtggattatcttctgaagaatggaaactgttagtccagaatgatgtgtttttctcaatgcagtgagttatagattctctagttttctccctagggatgggaagggggcattgaggcaagcctggagaggagcccggggagcagggtcatgaacttttttctttagtgaaggaggaatacaatcaagggttttgtattcagaatgttgtgcaatattttggaatgggacattggtgtgtttagagattttagtttaaaaacaaaacaaaaagattgatcaaatctgtacagtttctattgttccagatttttttaagtttgtattaaaagcatgatacataatagc

SEQ ID NO: 192400 - DNA, 777 bp, Homo sapiens
  Payload ID: 17998
  Gene Name: transducer of ERBB2, 2
  ENST ID: ENST00000434408
  CDS Start-End: 474-777
ggcgcgggaaggtgcgggttgttggctgaggcaagccgtggctcgggcgacgcggggccaggagggcaggaccgtctgccggcgacagcccataccgtctgccgttgcgcgacacgaaccaccctccgatccgccatccccgcgtcgtcgccgctagtccgcccgcccgccctcgggccccccgctgccgagcccgacctcctaagagctgaaagaaattattgagagtcatagtccatagccccctgcttcgtcccccaaccctcaacgacgaaaaggacttcggtcccctggcccggcgacgcccgggaaggaaaggagagcgacctccgccccgcgctcaggccaccctggagggagaagccgccccgcggccggtagagcgccccgccgccgcggagacccgagtgaagccgcctggagcccaaggctgtacacgtgccctgtgctgattctctgcctaggaaaggaccatgcagctagagatcaaagtggccctgaacttcatcatctcctacttgtacaacaagctgccccggcgccgggcagacctgtttggggaggagctagagcggcttttgaaaaagaaatatgaaggccactggtaccctgagaagccactgaaaggctctggcttccgctgtgttcacattggggagatggtggaccccgtggtggagctggccgccaagcggagtggcctggcggtggaagatgtgcgggccaatgtgcctgaggagctgagtgtctggattgatccctttgaggtgtcctacc

SEQ ID NO: 192401 - DNA, 611 bp, Homo sapiens
  Payload ID: 17999
  Gene Name: transducin (beta)-like 1 X-linked receptor 1
  ENST ID: ENST00000352800
  CDS Start-End: 178-611
aattgcctctcaccccccggaggggttattttgggggtggttggaggcggtggcggcggcggcgaggaggggaatttccttgtgcctccattcccgggaggggggagcggcgttggaggccaccgtttccagggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatca

SEQ ID NO: 192402 - DNA, 564 bp, Homo sapiens
  Payload ID: 17999
  Gene Name: transducin (beta)-like 1 X-linked receptor 1
  ENST ID: ENST00000422442
  CDS Start-End: 348-564
ttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacaggggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgt

SEQ ID NO: 192403 - DNA, 575 bp, Homo sapiens
  Payload ID: 17999
  Gene Name: transducin (beta)-like 1 X-linked receptor 1
  ENST ID: ENST00000428970
  CDS Start-End: 349-575
aggggcgcgcggcagccgggccttgctccgggacgtgtttatttgtaacttagtgctttttatcgtcttaaggaggtatttggtggaggctctttgaagttgggttcaggagtgtagaattggcaaagttattgccagcttcctggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgt

SEQ ID NO: 192404 - DNA, 565 bp, Homo sapiens
  Payload ID: 17999
  Gene Name: transducin (beta)-like 1 X-linked receptor 1
  ENST ID: ENST00000437738
  CDS Start-End: 130-565
atcgtcttaaggaggtatttggtggaggctctttgaagttgggttcaggagtgtagaattggcaaagttattgccagcttcctgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcata

SEQ ID NO: 192405 - DNA, 580 bp, Homo sapiens
  Payload ID: 17999
  Gene Name: transducin (beta)-like 1 X-linked receptor 1
  ENST ID: ENST00000443315
  CDS Start-End: 337-580
ttagtgctttttatcgtcttaaggaggtatttggtggaggctctttgaagttgggttcaggagtgtagaattggcaaagttattgccagcttcctgcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacaggggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgt

SEQ ID NO: 192406 - DNA, 559 bp, Homo sapiens
  Payload ID: 17999
  Gene Name: transducin (beta)-like 1 X-linked receptor 1
  ENST ID: ENST00000431674
  CDS Start-End: 271-559
ggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgacagcaaaaccaacttctcctcagccttgtgaagaggatgaggaccttcaggatgattcacttccatttaatgaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaac

SEQ ID NO: 192407 - DNA, 604 bp, Homo sapiens
  Payload ID: 17999
  Gene Name: transducin (beta)-like 1 X-linked receptor 1
  ENST ID: ENST00000422066
  CDS Start-End: 345-604
attttgggggtggttggaggcggtggcggcggcggcgaggaggggaatttccttgtgcctccattcccgggaggggggagcggcgttggaggccaccgtttccagagtttcactctgtcacccaggctcgagtgcagtggcgtgttctcggctcactacaacctccgtcctctgggctcaagcagtcctcgcatctcagcctcccaaggagctgggacctcagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgt

SEQ ID NO: 192408 - DNA, 554 bp, Homo sapiens
  Payload ID: 17999
  Gene Name: transducin (beta)-like 1 X-linked receptor 1
  ENST ID: ENST00000427349
  CDS Start-End: 370-554
attgcctctcaccccccggaggggttattttgggggtggttggaggcggtggcggcggcggcgaggaggggaatttccttgtgcctccattcccgggaggggggagcggcgttggaggccaccgtttccaggtgtgggaataagtatctttggaagaccaggcactttatgcagtattgagctcaggaggcagtgagtgttaaggaatgggtgtaaaacatcaacaacagcaacttgtgattggcggtgaccggatattcagttgcacatccccacatcaatgcactgccaatgtgggattacagctaagtattacgttttaaaggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagc

SEQ ID NO: 192409 - DNA, 550 bp, Homo sapiens
  Payload ID: 17999
  Gene Name: transducin (beta)-like 1 X-linked receptor 1
  ENST ID: ENST00000431421
  CDS Start-End: 385-550
attttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaa

SEQ ID NO: 192410 - DNA, 592 bp, Homo sapiens
  Payload ID: 17999
  Gene Name: transducin (beta)-like 1 X-linked receptor 1
  ENST ID: ENST00000424913
  CDS Start-End: 374-592
agtgctttttatcgtcttaaggaggtatttggtggaggctctttgaagttgggttcaggagtgtagaattggcaaagttattgccagcttcctgcatcaacaacagcaacttgtgattggcggtgaccggatattcagttgcacatccccacatcaatgcactgccaatggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaat

SEQ ID NO: 192411 - DNA, 7948 bp, Homo sapiens
  Payload ID: 17999
  Gene Name: transducin (beta)-like 1 X-linked receptor 1
  Uniprot ID: Q9BZK7
  ENST ID: ENST00000430069
  CDS Start-End: 261-1805
gcgcggcagccgggccttgctccgggacgtgtttatttgtaacttagtgctttttatcgtcttaaggaggtatttggtggaggctctttgaagttgggttcaggagtgtagaattggcaaagttattgccagcttcctgcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgctttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtcttttaagtatatacttttctgaaaggtatccattttgtaggcttgggttcttcatgagcatacgattgtttatttttgctgctgttctcaacatcatcattgcctgctgatgtgccacgatgctgctccaatagacagcaataagattgtctctaatttgagcagtaacatgattgcaagagaccaagtttcacagcttgtaaagttctgtatttgggattcttgcttatttttccgcctgtgtttttctgagaacttattcctgatgatcaattgaatccagtagtttttctatgctatttgttgttgtataagctactgtaagaaacttatcataaggaaaaatagaaaggaaaacttgaatcaatactcattgattaaaatggaataaagaaagagcagctgccacttttaaacaacataaaggaatatctttttttgtctccgtgtaggaaatcccataagttcttatatttgttccagttcccatttcctgccattgaccagataacatcattgactttcaaatgacttttagaagtgataactcttaatttcctaatagatactagattgtattgaattctgttttaattattctctaggtaagtatgttttaggattaaataccttttacagatactgaaagtgcctccttttgtggtgtaaaaaacaaattatggtgcaaaaagtaatcactagattgaaatacatgaaggttttttgctttttgacatacgaaaatgtcaagagaaaggccaaagatttgtactttttcacttacaaagcactcctttttcccttaaacttctttctgtcaaattagatttaatgagagagtactatttttaaggagctatctgtttatgtagaatgattttgttaagagtaatgtaaactattattgagtagaggcctaaagaggactgtgcatttttgctatttaaaggaatcacaaatgatcatacttaagtgagcaaaaatgacaagttttactagctaagtagagaaataaatctcaaatgcagcgctacaattttcattatcttaagtacattgtacatttctacagaacctgtgattattctcgcatgataaggatggtacttgcatatggtgaattactactgttgacagtttccgcagaaatcctatttcagtggaccaacattgtggcatggcagcaaatgccaacattttgtggaatagcagcaaatctacaagagaccctggttggtttttcgttttgttttctttgttttttcccccttctcctgaatcagcagggatggaaggagggtagggaagttatgaattactccttccagtagtagctctgaagtgtcacatttaatatcagttttttttaaacatgattctagttaaatgtagaagagagaagaaagaggaagtgttcacttttttaatacactgatttagaaatttgatgtcttatatcagtagttctgaggtattgatagcttgctttatttctgcctttacgttgacagtgttgaagcagggtgaataactagggcatatattttttttttttttgtaagctgtttcatgatgttttctttggaatttccggataagttcaggaaaacattctgcatgttgtatctagtctgatgtacttatccatctcattacaaacaaaaacacacagactgcatttgtagctctgtaatccttgaatacggaagtaaattttcttctttcctgactttgacattgtagctatactgtttccatttttgtttttacaaatcctttgggtctaattctgtgagcctacctatagcactggattaaaatgtctgcatcatttctttagttatccagttaactttaaaactgttgtaaaagtgtaaaccagcccatgacaggtttttgtacatgttaaagaacttcattgttcagttttcatgattattgtgtaaggaagactgatgtagatgttctgtgctgtcctggaccatgttaattacacttacgacgtattttagttccacatcacaatgatttgtccccagtgacccttttatcctttctaggcacatttcttgttgttgttgttgttgcagttcccctttgcattgtattgctttgacaactgtaatttgaatcagatctgaaagaggtccagaataaaatatattttgatattatgttggctgtgtacatatataaaacctttgatgtctatgtagtttatatagactatttactagtcaggtaaagagagagggatggtatttcttgtttacagtttgtttacattttaattgcttttacttctccagtgttctattgtagaataaacctttttttccaagttagccttcataacctataacacattcattctctcccatactggtgttactgattaataactgccatcagaacccaaaccactgtttttcataaacgtattgtttcccaagatatatactttaagcccataataaaattacaaattttactatttttattacttcttgcaggagataagatttttttaaatgaaggggttatttactatttttattaaagtataatagagcatctaatcagctaagggattgtaatttttaattcttttgaaaaataaatattgtatttaaaagacgttatttcacagaagctgaaaaagagaccttagataacatttgtttggttagccacacggttgagcacaaaacaatgtgtagatgtgttgaagattagggcaggaggctcaacttctcggtgacctttttttgcttcacaacaagccaattatagttgaatcattttctctcttagctagttgttactacaaactttataagaaaaacaactagacaccttctagttttaattaataccaactcctttagagttagagactttttaaaaagaatcattgagcatattttcttttttttttttttaagaatttacactctctaggtcttctatttttcctgtttatttccttaaacagaaataaattcaagcatagttttatgttttattagaaataagccactgcagttgctagaactgacatgctttcattttcaaggggttaacttttattgcatggcatagattattagtaatatcctgcattgtatacttttccaaaaagggttggactcctaaggattagaatccttataagcttgagggaaagctgaaactaatttgaacagtaatagaagggattatttttaatttcatagttaacactttacaatggattagatttattacctagtataatccgtagcagatcagatcaaagtttactgttttaccaatatattcatttgaaaaaatacagtggaggaaaagacactttagatggtagttttatggtgcttttctctgctgtaccaaagtgctttgtcatcaatgaaatgttaaccctatgctactttttctgcatgcttcttaaatgtcatcttaatgcttaattgtcctaacttgtaatatttttgtattaaatttttttaggagttccttgtaatttctttacaatttaaaatatattaaacacaaagtgtttagtaaagtaca

SEQ ID NO: 192412 - DNA, 588 bp, Homo sapiens
  Payload ID: 17999
  Gene Name: transducin (beta)-like 1 X-linked receptor 1
  ENST ID: ENST00000450267
  CDS Start-End: 229-588
ggggaatttccttgtgcctccattcccgggaggggggagcggcgttggaggccaccgtttccagatgaggaaactgaggccttggactagaacagaggtctcctgactcagtccaggactctttctattacatcatgcggcctgatatttgtctttatggaactcagcaacatcacatacaggggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaa

SEQ ID NO: 192413 - DNA, 4101 bp, Homo sapiens
  Payload ID: 17999
  Gene Name: transducin (beta)-like 1 X-linked receptor 1
  Uniprot ID: Q9BZK7
  ENST ID: ENST00000457928
  CDS Start-End: 398-1942
ctccccccgccgccggccgcgtgcgcccccgcccctccccccgcggcgggagcacctccgctcgccacctggggacccgcgccgcgctccccgcccccgcccgcccggcgcccatcccccgcgccctccgctcgctggggttataattgcctctcaccccccggaggggttattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgctttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaa

SEQ ID NO: 192414 - DNA, 592 bp, Homo sapiens
  Payload ID: 17999
  Gene Name: transducin (beta)-like 1 X-linked receptor 1
  ENST ID: ENST00000413084
  CDS Start-End: 494-592
tattttgggggtggttggaggcggtggcggcggcggcgaggaggggaatttccttgtgcctccattcccgggaggggggagcggcgttggaggccaccgtttccagcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacaggtagagacggggtttcaccgtgttagccaggatggtctcaatctcctgacctcgtgatctgtccgccttggcctcccaaaggtttgggattacagacgtgagccaccgcacccagccgatattgttttattttaatcaaggcaaaactggttatatcctgtgttgtgacctcatggtttaagtgggaataaagatgagtataagcagtgatgaggtcaacttcttggtatatagatacttgcaagagtcaggattttctcattcagcatttacctttggtatagaaagccat

SEQ ID NO: 192415 - DNA, 567 bp, Homo sapiens
  Payload ID: 17999
  Gene Name: transducin (beta)-like 1 X-linked receptor 1
  ENST ID: ENST00000630833
  CDS Start-End: 252-567
attcccgggaggggggagcggcgttggaggccaccgtttccaggtgtgggaataagtatctttggaagaccaggcactttatgcagtattgagctcaggaggcagtgagtgttaaggaatgggtgtaaaacatcaacaacagcaacttgtgattggcggtgaccggatattcagttgcacatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagc

SEQ ID NO: 192416 - DNA, 656 bp, Homo sapiens
  Payload ID: 17999
  Gene Name: transducin (beta)-like 1 X-linked receptor 1
  ENST ID: ENST00000630796
  CDS Start-End: 290-656
gggcgcgcggcagccgggccttgctccgggacgtgtttatttgtaacttagtgctttttatcgtcttaaggaggtatttggtggaggctctttgaagttgggttcaggagtgtagaattggcaaagttattgccagcttcctgcatcaacaacagcaacttgtgattggcggtgaccggatattcagttgcacatccccacatcaatgcactgccaatgatgaggaaactgaggccttggactagaacagaggtctcctgactcagtccaggactctttctattacatcatgcggcctgatatttgtctttatggaactcagcaacatcacatacagggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaa

SEQ ID NO: 192417 - DNA, 4186 bp, Homo sapiens
  Payload ID: 17999
  Gene Name: transducin (beta)-like 1 X-linked receptor 1
  ENST ID: ENST00000631253
  CDS Start-End: 74-1498
acatccccacatcaatgcactgccaatgggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcagctgccgcagctgcagccagccaacaaggatctgcaaaaaatggagaaaacacagcaaatggggaggagaatggagcacatactatagcaaataatcatactgatatgatggaagtggatggggatgttgaaatccctcctaataaagctgttgtgttgcggggccatgaatctgaagtttttatctgtgcctggaaccctgttagtgatctcctagcatcagggtctggagactcaacagcaagaatatggaatcttagtgagaacagcaccagtggctctacacagttagtacttagacattgtatacgagaaggagggcaagatgttccaagcaacaaggatgtcacatctctagattggaatagtgaaggtacacttctagcaactggttcctatgatgggtttgccagaatatggactaaagatggtaaccttgctagcaccttagggcagcataaaggccctatatttgcattaaaatggaataagaaaggaaatttcatcctaagtgctggagtagacaagactacaattatttgggacgcacatactggtgaagccaagcaacagtttccttttcattcagcaccagcattggatgttgattggcagagcaacaacacctttgcttcttgtagtacagatatgtgcattcatgtctgtaaattaggacaagacagacctattaaaacattccaaggacatacgaatgaagtaaatgctatcaaatgggacccaactggcaatctcttggcctcctgttctgacgacatgactttaaagatatggagtatgaaacaagacaattgtgtccatgatttgcaagcacataataaagaaatttatactatcaaatggagtccaacaggaccagggactaataatccaaatgccaaccttatgttagcaagtgcatcctttgattctactgttaggttatgggatgtagaccgagggatatgcatccataccttgacaaaacaccaagagcctgtgtacagtgtagctttcagtcctgatggcaggtatctggcaagtggttcttttgacaaatgtgtacacatctggaacacgcaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaacaaaattgcaccctgaagatgacagagttttgtcacagcttgtgaattctgttcaccaagtgctggaatctaatctgctgtgcccctaaaatagcatttagaagttttggatatgaaaaacagaagagagaaaaatatacattataaaagcagaacatacatgtaccagtttttggatactaaatgacagccttgtttctcccctttgaatcagcagacaccatggattatattctttttttcccttcagtagtgagcagtttgtatgtacagagaaaatggacttacaaaaacttgcagcagtagtttgttcttgctttaaaatttcgtttttggtttagattatggatgcatgaagtaagggagtgaatcagtttcttgtttatatttttttcaccttttaaacaaaaaattctttaaaatattttaatgcattcttttgaagaggtagatgtttggtacattttatggctcccagagcatatattcagttggtgcatgttgtggaagggggaattggaaattaaatgaaaacctatgactttggtcatgtcaatctgtaagacacatcagtaaaagggtattatgctctgttggttttgtttttttgttttgctttttttttttttttttcttttttgttttttggtgatgtggcttaaatgcaatagtttcttttttgggacatatttctgccaattaaagactagaagggcacaactttttttttaattaccatagagaagatacattaaaaaaaatcttctgatgttttgtagccataactaaattatggtaaaaatgtgcactattgtgaaaaggagcaacgtagttttgggttttttgttgtttgtttgttttgctttgttttttaagagattaaaatgtttctggataaggattagcttctcgaagtgtccatcattctgtgtagaagcttaaatatgtaatgtaaccaaactccagtattaaaaatctctcatgttgttttctttatacaaagcaagataacggcatataacactgccattacatggcaaaatgtttgctaccttagtttaaaaaacaatctcaaacaaaagacttgcttcaaggtgtttttaaatagcagtgattcagaattttttttaatgaaagtataattgcactaaccttcttcctgctgctctgattctgcatttgtggtacttgtgactacgttttttcaaatatagatagatttaagctgctaatttttttttttttagtaatcactactatatcatgtcttttactctgtttataatatcaagtattttcttaaagatatagatattaaaccttgtgctcatgcaacttagagtaacatatacagacaaatgattgcatgaggccatgtttatatgtgtgactaataaggcttgtcatgattaacataatccaggtatgtcatttctgaagagaatagtcatcaaatttatatctcgaagattttaattaaggaattgcttattgttgagcttagcaaattaataacactatttctgtcactaattattttgaggccttttagtactaaaattttaacctgtgttctaagtagaaactgatttaacccaagtaatgcagctttgattgatttcagcattcgttgctttgctatttttacaaaacagcattgattgaagcaagtcttggttttactaaggtagggtagcatttgctattggtaaagagaataaatacacttaatttcacaatacattgttatatgtaccccagttgttgttagtggggactatgatactgtaataatatttttaaaaatttacatcaagagaggcagtcattcacgatggttttgtgccagctctttttagggttttggatcacattagagatatttagaacatattaccctgtgacttacgtaggaaacctaatatgctgagtatctggcacttgaattcctgcttttattgctggaggtccacatctgtggttgacctctgttattgtttaaaaaaaataaataaaaattaaaaaaatctgtgcaataattttaaaatgtgctcccaggaatagacacaaatgttttgagtatcttttaagctgcattttcctttagtgatgcatttgtcaattgcactgaatttaaatctgaaagtcagaggtgattattgatagtacttttgtattttgatatggacagtttattcatttgcatacagttattgactttttcccagctgattaaaagatagtcaagaaattctgcaatatagctgccaaaatagacagctacatttttatgatattgtcatcttttctgttttttttttcttttttttctttagctattttacttaagcataatagccacaataggacatataaaagattataaatacagagctttattatcctgacgtcttgggtctt

SEQ ID NO: 192418 - DNA, 355 bp, Homo sapiens
  Payload ID: 17999
  Gene Name: transducin (beta)-like 1 X-linked receptor 1
  ENST ID: ENST00000626758
  CDS Start-End: 1-202
taataatccaaatgccaaccttatgttagcaagtggttcttttgacaaatgtgtacacatctggaacacgcagacaggtgctctagttcacagctataggggaacaggtggaatatttgaagtttgctggaatgcagcaggagacaaagttggagccagtgcatcagatggttcagtttgtgtattagaccttcggaaatagcgctactagttggaagccatggaccgactatgaatgtgtacatagccaaaatgactgtccctgacccatgtactgctatagtcccacttgaaccatggccagtccactacagccaaatctaaaagaaatatatacatacagtgtatataaaca

SEQ ID NO: 192419 - DNA, 568 bp, Homo sapiens
  Payload ID: 17999
  Gene Name: transducin (beta)-like 1 X-linked receptor 1
  ENST ID: ENST00000626672
  CDS Start-End: 232-568
ttattttgggggtggttggaggcggtggcggcggcggcgaggaggggaatttccttgtgcctccattcccgggaggggggagcggcgttggaggccaccgtttccagatattttcctcttctggaccctatctagaagaagtattccttagacaatttccggcttcttttctctcatgaagaggagggttatatcctgtgttgtgacctcatggtttaagtgggaataaagatgagtataagcagtgatgaggtcaacttcttggtatatagatacttgcaagagtcaggattttctcattcagcatttacctttggtatagaaagccatatcagtcagtccaatataaatggtgccctcgtcccacccgctgcattgatttctatcatccagaaaggtctacagtatgtagaagcagaagttagtattaatgaggatggtaccttgtttgatggtcgaccaatagagtctctgtccctgatagatgccgtaatgcctgatgtagtacaaacaagacaacaagcttatagagataagcttgcacagcaacaggcagcagctgctgcag

SEQ ID NO: 192420 - DNA, 2312 bp, Homo sapiens
  Payload ID: 18000
  Gene Name: transducin (beta)-like 1, Y-linked
  Uniprot ID: Q9BQ87
  ENST ID: ENST00000346432
  CDS Start-End: 553-2121
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 192421 - DNA, 2376 bp, Homo sapiens
  Payload ID: 18000
  Gene Name: transducin (beta)-like 1, Y-linked
  Uniprot ID: Q9BQ87
  ENST ID: ENST00000355162
  CDS Start-End: 617-2185
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 192422 - DNA, 2407 bp, Homo sapiens
  Payload ID: 18000
  Gene Name: transducin (beta)-like 1, Y-linked
  Uniprot ID: Q9BQ87
  ENST ID: ENST00000383032
  CDS Start-End: 648-2216
ccagtgcccccaattcgcgctcgggagtgaggagccgccaacaccccagctccgctgctgccgccaccgcagtgctctctagtcgccattggttacctaaactttccagtacccgcgacctttccgggactccgcggcggcggggcagaggcggcccaggggcggcacgcggctgctccggtgcgccgggctcttttcggccgccgcacggccgggcctcacaggctgccctcctgagagaggctcagaacacggccaggtacgcgccgccgccacagttgcgctgctagcgacgaggtgttttcctctgctggcacgccagaatccctggttcagcctggaaggcgaggggcaggactccccagacagtggcctcagtgtggcattgatgtcctaggttgtaaggtgctaaggggaatgccagctgttctcttaacagaagggcagtttttgaagaaatgaagcaggacttgatgtggattgtcataaactgtttctccctaaagaggctggtccccacagacggcttgccatttctatgactggatgctgagaagcctgctggttcagaggtccacacatgaagttaccataaagagggtggttccaacttcatcaatacctcatcgccatgaggtgaggctaagatgagcataaccagtgacgaggtgaactttctggtttatcggtatctccaggagtcaggtttttctcactcggctttcacgtttgggatcgagagccacatcagccagtccaacatcaatgggacactagtgccaccgtctgccctcatctccattctccagaagggactgcagtatgtagaggctgagataagcatcaacaaggatggcacagtgttcgacagccgccctatagagtccctgtccctgatagttgctgtgattcctgatgtggtgcagatgcggcagcaggcatttggagagaagctcactcagcagcaagccagtgcagcagccacagaggcatcagcaatggcaaaggcggcaaccatgaccccagctgctatttcccagcaaaatcctccaaagaaccgagaggccacagtgaacggggaagagaatggagcacatgaaatcaataatcactcaaagccaatggaaatagatggggatgttgagattccacccaacaaagccacagtccttcggggccacgagtctgaggtgttcatttgtgcctggaaccctgtcagtgatttgctagcctctggatctggagactcaactgcaaggatatggaacctgaatgagaatagcaacgggggctccacccagctcgtgttgagacattgtatacgagaaggggggcacgacgtcccaagtaataaagatgtcacctcactggactggaacagtgatggaacactattggctatgggttcatatgatggtttcgcaagaatatggacagaaaatggtaacctggccagcaccttaggccaacataaaggccccatcttcgctctgaaatggaacaaaaaggggaattatgttttgagtgctggtgtagacaaaacaacaataatttgggatgctcacacaggagaagccaaacagcagtttccttttcattcagcccccgcccttgatgtggactggcagaacaacatgacctttgcctcctgtagcacagacatgtgtatccatgtgtgcaggctcggctgtgaccacccagtcaaaaccttccagggacacacaaacgaggtcaatgccatcaaatgggatccttctggaatgttgctggcgtcctgctcggatgacatgacattgaagatctggagtatgaagcaggatgcatgcgtccacgatcttcaggctcacagcaaagagatctacaccatcaagtggagccccaccgggcctgccaccagcaacccaaactccagcatcatgttggcaagtgcttcatttgattctacagtgcgactgtgggatgtggagcaaggtgtctgcacccacacactcatgaagcatcaagagcctgtctacagtgtagctttcagccccgatggaaagtacttggctagtggatcctttgacaagtatgttcatatctggaatactcagagtggaagtctcgtccacagctaccaaggcactggcggtatcttcgaggtgtgctggaacgcccgaggagataaagtgggcgccagcgcgtctgatggctctgtgtgtgttctggatctgtgaaagtaaacacaaaatatagaaaaaaagaaaagaattctaatgacctgccttgaatgcatggggttgcagctctgttcaaacacaattctatcagctccaaaatgtgtgaacttgacttgtgttagagtatattctgaaaccaacttgtcccaggccacaggagtgtatatgtttcataatctttatcaaga

SEQ ID NO: 192423 - DNA, 5871 bp, Homo sapiens
  Payload ID: 18001
  Gene Name: transducin (beta)-like 1X-linked
  Uniprot ID: O60907
  ENST ID: ENST00000217964
  CDS Start-End: 641-2374
gggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattagagaa

SEQ ID NO: 192424 - DNA, 4674 bp, Homo sapiens
  Payload ID: 18001
  Gene Name: transducin (beta)-like 1X-linked
  Uniprot ID: O60907
  ENST ID: ENST00000380961
  CDS Start-End: 478-2058
gcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaagctcctggcaaccactattccactccctgcttctttgaatttcacaacttgaggtagcttgtgtaagtggaattattttaaaagctggttcatgttaaagtgcttagaacagagcttggtgagcatccggtcaacagctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcct

SEQ ID NO: 192425 - DNA, 5596 bp, Homo sapiens
  Payload ID: 18001
  Gene Name: transducin (beta)-like 1X-linked
  Uniprot ID: O60907
  ENST ID: ENST00000407597
  CDS Start-End: 369-2102
attgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 192426 - DNA, 5451 bp, Homo sapiens
  Payload ID: 18001
  Gene Name: transducin (beta)-like 1X-linked
  Uniprot ID: O60907
  ENST ID: ENST00000424279
  CDS Start-End: 377-1957
attgcatgtaatacctcagcatcagtctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcaataatcacgcgaagccaatggaaatagatggagaggttgagattccatccagcaaagccacagtccttcggggccatgagtctgaggtgttcatttgtgcctggaatcctgtcagtgatttgctagcctccggatctggagactcaactgcaaggatatggaacctgaatgagaatagcaacgggggctccacccagctcgtgttgaggcactgtatacgagaggggggccatgacgtcccgagtaacaaagacgtcacctcactggactggaataccaatggaacactcttggctacgggttcatatgacggttttgcaagaatatggacggaagatggtaacctggccagcaccttaggccaacataaaggccccatctttgccttgaaatggaaccgaaaggggaattacattttgagtgctggtgtagacaaaacaacaataatttgggatgcccacacaggagaagccaaacagcagtttccttttcattcagcccctgcccttgatgtggactggcagaacaacacgacctttgcctcctgtagcacagacatgtgtatccatgtgtgcaggctcggctgtgaccgcccagtcaaaaccttccagggacacacaaacgaggtcaacgccatcaaatgggatccgtctggaatgttgctggcatcctgctcggatgacatgacattgaagatctggagcatgaaacaggaggtgtgcatccatgatcttcaggctcacaataaagagatctacaccatcaagtggagccccactgggcccgccaccagcaacccaaactccaacatcatgttggcaagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcagagtggaaatcttgtccacagctaccgaggcactggcggcatcttcgaggtgtgctggaacgcccgaggagacaaagtgggtgccagcgcgtccgacggctctgtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatattaga

SEQ ID NO: 192427 - DNA, 387 bp, Homo sapiens
  Payload ID: 18001
  Gene Name: transducin (beta)-like 1X-linked
  ENST ID: ENST00000452824
  CDS Start-End: 149-387
caacttgaggtagcttgtgctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtgaactttctggtgtatcggtatctccaggagtcaggtttttcccactcggctttcacgtttgg

SEQ ID NO: 192428 - DNA, 520 bp, Homo sapiens
  Payload ID: 18001
  Gene Name: transducin (beta)-like 1X-linked
  ENST ID: ENST00000441088
  CDS Start-End: 344-520
tctgcacaagcccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagagagggtggttcccacttcatcaacacctcatcgccgcgaggtgaggctaagatgagcataaccagtgacgaggtg

SEQ ID NO: 192429 - DNA, 565 bp, Homo sapiens
  Payload ID: 18001
  Gene Name: transducin (beta)-like 1X-linked
  ENST ID: ENST00000415293
  CDS Start-End: 341-565
ccagggagcccaggagcaacgaagggcaggctcaagggaaggccccaccatgtccttctggggggccttgaatggcaactgatacataataagacacaatctattctgctgattcacaattatggagactgtatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggatggcacagtgttcgacggc

SEQ ID NO: 192430 - DNA, 496 bp, Homo sapiens
  Payload ID: 18001
  Gene Name: transducin (beta)-like 1X-linked
  ENST ID: ENST00000422314
  CDS Start-End: 363-496
gcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgagatttccgtgagggtggaagaaaatcataccatatcagatgcctcgcagagcaccaggcccaccgtgaaaggctggtccctgcagacggcttcccatttttatgaccggatgctgggaagcctgctggtccacaggtccatacatgaagtcaccataagagggtggttcccacttcatcaacacctcatcgccgcgaggtgaggctaagatgagcataaccagtgacgaggtgaactttctggtgtatcggtatctccaggagtcaggtttttcccactcggctttcacgtttgggattgagagccacatcagccagtccaacatcaatgggacgctagtgcc

SEQ ID NO: 192431 - DNA, 3161 bp, Homo sapiens
  Payload ID: 18002
  Gene Name: transducin (beta)-like 2
  Uniprot ID: Q9Y4P3
  ENST ID: ENST00000305632
  CDS Start-End: 243-1586
ccaggccccgcccctcgagcgccacaacagccgggccccaccccttgaggtgctttaacggccaggccccgccctgaaggcgttgtaacaaccaggctccgcccccaggcgctctaacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataagacatggtttctgccatcaaagatggctggtgggagagagagatacacccttattaagtgctttgtgttagtttattcatagctattgttatatatgtcaaggcaagagaggaccagagcaggacagaggcaatgggtattgaagttgaaggggtacatttgataagagagtcggtattgagaagtttaaatttgtgaatttgaaggctgcgtgggtgtggcaggtaagggaaatgaggtatctgggaaggcttgagtgtaggcaaatttattcatcccaagtcaaactcttgatctctctcacgaaaactatgaccccccctggttgcccctgacctctcaatgttggaacaagccacaaccgtggagttatccttgatgactccccattcattatcccttctgtcccaccaccacagctgtcatctgttcaccagaacgttcttttggttacactccatgtgacatcctgaggctgttgcttctctccagcttttctgttaccatcctggtcctggctactgtcacctagtgggccactataatatggcttcctaatggatcttcctgcttcctctgttgcctcattacttttctatatagcagaatgatcttttgaaaatgtgaaccagatcacattattccctagttaaaaccccccaaggcttcccatcacacttggaataaaatccaaaagaatttttctaaaccaaaaatagtaaaaacaa

SEQ ID NO: 192432 - DNA, 2276 bp, Homo sapiens
  Payload ID: 18002
  Gene Name: transducin (beta)-like 2
  ENST ID: ENST00000424598
  CDS Start-End: 28-168
agctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgtgggcagtaaatgcttatcagtgagtaactggagaacaacatggcccttccttataggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataa

SEQ ID NO: 192433 - DNA, 834 bp, Homo sapiens
  Payload ID: 18002
  Gene Name: transducin (beta)-like 2
  ENST ID: ENST00000437521
  CDS Start-End: 61-180
cggcctcctcgtggtccgacctgcggtttgggcccgcggctggtggggcccggcgactccatgggcctcagtttctcctctgggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtg

SEQ ID NO: 192434 - DNA, 1423 bp, Homo sapiens
  Payload ID: 18002
  Gene Name: transducin (beta)-like 2
  ENST ID: ENST00000433464
  CDS Start-End: 51-374
gtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaa

SEQ ID NO: 192435 - DNA, 673 bp, Homo sapiens
  Payload ID: 18002
  Gene Name: transducin (beta)-like 2
  ENST ID: ENST00000458466
  CDS Start-End: 51-182
gtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctagacggggacccgccttgccgggttaggcgcacctcctggggcgggactggctccaacctgggccccttactgcggctttctctgtggccgaggccaggccgtccccggggtggccaggagagcaccgtaaactcttcagcctgctccgtggccgcgatctcggaaaaagcaccaattctgtgatgtgcagcagcatttactgggcatctatgaccctgtgataggctttggggtctttttctgtaaggagtccagtaaaggagaagtacatctgtattatgaacacctaaatatggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttc

SEQ ID NO: 192436 - DNA, 1717 bp, Homo sapiens
  Payload ID: 18002
  Gene Name: transducin (beta)-like 2
  ENST ID: ENST00000417008
  CDS Start-End: 6-137
ccaacatggagctctcgcagatgtcggagctcatggggctgtcggtgttgcttgggctgctggccctgatggcgacggcggcggtagcgcgggggtggctgcgcgcgggggaggagaggagcggccggcccgcctagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaag

SEQ ID NO: 192437 - DNA, 1109 bp, Homo sapiens
  Payload ID: 18002
  Gene Name: transducin (beta)-like 2
  ENST ID: ENST00000435792
  CDS Start-End: 128-292
aacggccaggcccagccgcttgaggctccccaacggccaggccgcgcccccgcgtgcgtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctggtcttgctctgtcactcaggatggaatgcagtagtgttgtgatcatagcttactgcagcctcgaactcctgggctcaaatgatccaaagcattgggattacaggcatgagccaccatacccagccagccaaagcctctgtttttgcccatatcacactcattctcctccagaagacaagggccatatctggttaatctcctgctgttccactcaatgcctggctcatcataggtgggcagtaaatgcttatcagtgagtaactggagaacaacatggcccttccttataggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatga

SEQ ID NO: 192438 - DNA, 2209 bp, Homo sapiens
  Payload ID: 18002
  Gene Name: transducin (beta)-like 2
  ENST ID: ENST00000450285
  CDS Start-End: 42-572
cccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctgagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacgaataa

SEQ ID NO: 192439 - DNA, 1196 bp, Homo sapiens
  Payload ID: 18002
  Gene Name: transducin (beta)-like 2
  ENST ID: ENST00000426966
  CDS Start-End: 71-298
gtgcgcggcccggcagagccgtgcgggcgcccgcgtactcactagctgaggtggcagtggttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctggcccaggagcttttttcctgttggaattggggagcatctgcagtcatttaccacatgccagctttgtgactcaattaagtatcttttacaaaagtgactggctccactcccccgcacaggactcaacagatgttgacttctcatccccgagttctttcaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaa

SEQ ID NO: 192440 - DNA, 1573 bp, Homo sapiens
  Payload ID: 18002
  Gene Name: transducin (beta)-like 2
  ENST ID: ENST00000432538
  CDS Start-End: 26-1261
gcggctggtggggcccggcgactccatgggcctcagtttctcctctggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagagaccctgaagagcctgggtgccctgaagaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttg

SEQ ID NO: 192441 - DNA, 576 bp, Homo sapiens
  Payload ID: 18002
  Gene Name: transducin (beta)-like 2
  ENST ID: ENST00000452125
  CDS Start-End: 44-238
gacctgcggtttgggcccgcggctggtggggcccggcgactccatgggcctcagtttctcctctggtaacgtgagcttcgcttccagagacggggacccgccttgccgggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacaca

SEQ ID NO: 192442 - DNA, 494 bp, Homo sapiens
  Payload ID: 18002
  Gene Name: transducin (beta)-like 2
  ENST ID: ENST00000479892
  CDS Start-End: 205-494
ccaggccccgcccctcgagcgccacaacagccgggccccaccccttgaggccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcat

SEQ ID NO: 192443 - DNA, 2165 bp, Homo sapiens
  Payload ID: 18002
  Gene Name: transducin (beta)-like 2
  ENST ID: ENST00000610724
  CDS Start-End: 12-1352
gttccaccaacatggagctctcgcagatgtcggagctcatggggctgtcggtgttgcttgggctgctggccctgatggcgacggcggcggtagcgcgggggtggctgcgcgcgggggaggagaggagcggccggcccgcctgccaaaaagcaaatggatttccacctgacaaatcttcgggatccaagaagcagaaacaatatcagcggattcggaaggagaagcctcaacaacacaacttcacccaccgcctcctggctgcagctctgaagagccacagcgggaacatatcttgcatggactttagcagcaatggcaaatacctggctacctgtgcagatgatcgcaccatccgcatctggagcaccaaggacttcctgcagcgagagcaccgcagcatgagagccaacgtggagctggaccacgccaccctggtgcgcttcagccctgactgcagagccttcatcgtctggctggccaacggggacaccctccgtgtcttcaagatgaccaagcgggaggatgggggctacaccttcacagccaccccagaggacttccctaaaaagcacaaggcgcctgtcatcgacattggcattgctaacacagggaagtttatcatgactgcctccagtgacaccactgtcctcatctggagcctgaagggtcaagtgctgtctaccatcaacaccaaccagatgaacaacacacacgctgctgtatctccctgtggcagatttgtagcctcgtgtggcttcaccccagatgtgaaggtttgggaagtctgctttggaaagaagggggagttccaggaggtggtgcgagccttcgaactaaagggccactccgcggctgtgcactcgtttgctttctccaacgactcacggaggatggcttctgtctccaaggatggtacatggaaactgtgggacacagatgtggaatacaagaagaagcaggacccctacttgctgaagacaggccgctttgaagaggcggcgggtgccgcgccgtgccgcctggccctctcccccaacgcccaggtcttggccttggccagtggcagtagtattcatctctacaatacccggcggggcgagaaggaggagtgctttgagcgggtccatggcgagtgtatcgccaacttgtcctttgacatcactggccgctttctggcctcctgtggggaccgggcggtgcggctgtttcacaacactcctggccaccgagccatggtggaggagatgcagggccacctgaagcgggcctccaacgagagcacccgccagaggctgcagcagcagctgacccaggcccaagtgactctgggagggcccggcgcagaggattgaggaggagggatctggcctcctcatggcactgctgccatctttcctcccaggtggaagcctttcagaaggagtctcctggttttcttactggtggccctgcttcttcccattgaaactactcttgtctacttaggtctctctcttcttgctggctgtgactcctccctgactagtggccaaggtgcttttcttcctcccaggcccagtgggtggaatctgtccccacctggcactgaggagaatggtagagaggagaggagagagagagagaatgtgatttttggccttgtggcagcacatcctcacacccaaagaagtttgtaaatgttccagaacaacctagagaacacctgagtactaagcagcagttttgcaaggatgggagactgggatagcttcccatcacagaactgtgttccatcaaaaagacactaagggatttccttctgggcctcagttctatttgtaagatggagaataatcctctctgtgaactccttgcaaagatgatatgaggctaagagaatatcaagtccccaggtctggaagaaaagtagaaaagagtagtactattgtccaatgtcatgaaagtggtaaaagtgggaaccagtgtgctttgaaaccaaattagaaacacattccttgggaaggcaaagttttctgggacttgatcatacattttatatggttgggacttctctcttcgggagatgatatcttgtttaaggagacctcttttcagttcatcaagttcatcagatatttgagtgcccactctgtgcccaaataaatatgagctggggattaaatacg

SEQ ID NO: 192444 - DNA, 2091 bp, Homo sapiens
  Payload ID: 18003
  Gene Name: transducin (beta)-like 3
  ENST ID: ENST00000332704
  CDS Start-End: 1-2091
ggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgcccta

SEQ ID NO: 192445 - DNA, 518 bp, Homo sapiens
  Payload ID: 18003
  Gene Name: transducin (beta)-like 3
  ENST ID: ENST00000561907
  CDS Start-End: 95-328
ggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagacctctctgtccccagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgg

SEQ ID NO: 192446 - DNA, 6803 bp, Homo sapiens
  Payload ID: 18003
  Gene Name: transducin (beta)-like 3
  Uniprot ID: Q12788
  ENST ID: ENST00000568546
  CDS Start-End: 129-2555
gcgcggtgacgccatcgcagcgcgccgggagtgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccggcgtggcctctggtgcgtccagttctctcccatggaccaggtgctggccacggcctcagctgatggcaccatcaagctctgggcactccaggacttcagctgtctcaagacatttgaggggcacgatgcttctgtgctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcactgcagccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaagaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccctagccggtccggcctctctccagtccatcctgaacccctggaaaacccataaaggccgctctcctggccggctctgtctctctggactgcagtccagccccccaccctggccaacaccctacctagccagccagaagggcactggagctgatggtctcggccctgccacgcccatcccgcaccctggcctggcagagatccagcccgcggctccgcacgcttagacggtgggggtcatgcagaacaagctttactcagaggaacagcaaatggccccctcccatccctgctggccagggagatccgccctccccgctcctccccagccctgggatggcgcggtccatcccctcatcgggatcctcgcgctcactgctccgtcgtggggtgcggcacagagtccacgcaccctcgagggcggccctggcgccgtgggcgccgctccagggccctgcgtgtgacggtgcagcagcggctctggatggcgcccggcgaaggtcgggtgggcacggtggggggaggggcggtggcctgggagggttcagggaagccccgggcctcacccgccgggtcgtctcctccacggaaccccgtcccgctcaggagagcgcccagcccttccggccgcagcagcaccgcggggagtaggcccgcccggtcgccgtacctgcgaggggcggggtgtggttagggccccgcccgcctcggctagcctgccctgcccacgcccgctcccgcgtacctgcatagccaccagccgcggtctgacgtttccaacacgcgcacgcgcgcccccgcgggcacggacagctcatctgcgcggctgctctcgtaggcgcgggaagcacagaactggggacctggtgggagtgggtgtttggagtcaccgcggggccacagaggacgaggcccgcccgcacccttctccacattctccttgcttgagtctgctgacggcggggccgctctaagaccggttcggggcttcctctaggtgcggagaccaagcacgggctcctggcccgccctgcccgcggtgcttctggcccagtcttgccacacggtcaagccgcagtggtggcgtgaggggtggggttaggcgcataccgctgctccctagggacgggcctccctcccggccttggcccggggccgcctcctccaggtagggcgctggaaaccaggcggtctgccggtcttcgttctccaccagccaccagcctgtgcgcaagaagcgggcagggactcaaatctcgaggctccctcgggtccaggagcagaggagcaaatccctgggttcttggggggccctacctgaggggtgccgcagcagcacgtccaggctctcctgggcctgcgcctgaaaaggcctatcccgcgtgtcctgggtacagaagggctgcaggcagcgcaggctctgagcctccagactgtggatggagaggcggcccgcagcgcgagaaagaggctgctcctctggggtgggcaggatcacccggctgggaagggcagcccgtacgagtgagaggtaggcggatggggagggtgaaactgggggcgccaccccggcaagaccgccagcctcccactctctgcccctattcgctggctgttcccccccaccctggacctctcccagctccaaacgccgctgcatgctgggagtttggggcgagtcaggcacctgccgggtggcagcgcgggctccaggtccaggggttgcggtgcgaagaagccagtgatcgtcgggctccgtgccacgcgctctgcagtcgccagcagcctccgagaataggtttccaacagctgcaggcgcgccaggccgcggctcgtgcgccccacgcgtcccaacagtggtgcatcttaaggcaccacaaaaacgtactgtgatacgccgctttgggcttcactggtccctggcgcccccaggcaagccaccgccttccccgctcccgtacccaggctggcctgaccgagaagctttgggagaacgcggtcagatctccgcagcaggcccgcctccaccgggaaggtctccttgagggtcttctgagggcgggaaccagggcattggtcttccagagcccactgtgcacccttgagagggcggggtccctcacccggatggcaggggctgggagcttcagcagggacgaagggcctccagtgggagtcactgatgggaggcagtccagtgggaggcagccgcgtggggaagccgccaccgcggcatcagggtggcccagggtcactcaccttgagctgcctgaattcgtcccaactcctgcgcacgaaggtgtcgctgccgtctgaccagcgcacagagaaggcaaacgtctgggggacaaaaagttgggagtgccgtggaggtgctggtccaggcacccccttcctatcccttggggccactaaggacccagccaggtcttacttggagcctcttgatctgcaccagggctgccccttgcactgaaactgggtatcgggggcctgccatggctgtggcttccaggctgcagattcctgaaatgggcgaggacccttctgcctccccgtgcttgagagggctctgggggacccagaaaaccccctgggatagaatcctggcaacacctcaagcctgtggggtccttgtggagccgccccagctgagtcctttgcagctttcttgctgtcccccaagcccacgatctgggggcaggagcacagggattgggggacttccaggcagagctgctgggaggaagaagaagaatgagctttccagccctggaggcgtgcaagactgaagaaggggcgaagggtaggcgggactgctgcctggggccctcctgcctgcctctggccacaggaggagggaggagaaggcagggctaatcaaagcgccacctgtcctgcccacctctctggattcccctaccctgtgaggtaattgccctgccagggtgcgcccaacaactttgaactggcctggggatttctgtgcagaaccaaggactcagtgcttacagctttaagtgctttgtctgacttaatcctaatgctggaggaaaggtctcttaatgtccccaactcatagaggaggaaatgtgtgttaaatgcgtaattattgtgagctgttctatacatgctgggggaggggcagacctcacaggctcaccccaggggttcccctgcagtgaggagacttggggtaggagaaagagggcccatctgtgcagtcactggcatttggtgggtgggggtggtggtcagggaagtggtcactagggctgttttgagaaccacctctcaattcacgatttgccatgacttactgcaaacatggcctgggcagaggctcgcccaggtgccccacctctctggctgcttccttatagttcgggcttcggaagccacattcaaccctggcacacagtggtttttcctcgtgctggggccaccagttctgtgttgggatgcacctactccagccccttcagggagcagtcagcctctaaggcatccctccaggaagctgccctggctgcaacaaagggcctttgtgtgtctgtcccaccagcactctctctcatgccctcaagctgtccctggtcttggcatgggcaatgaacacctgctcacatagggctgatttgcagggttcccccagccagctgtcaccttctccctgtctcagctgagggcccagctgacctggtggggtccagcgtgtgaacccaggggagaccttgctcccctggaagacaggagaagctggggaggatttattcacaagcagaggcctagagggattctgaggccacctgcctaccccagctgacagctcctgccccacaccccatcagccctgcatggtttccactttttcctcccctaccctcttttcttgcctgaatagtacaccccaccctccatctgtatgctcctcacttgcccctacaaaatccactccaaggacagacacagtgcctcacctgtaatccaagtactttgggaggccgaggcagggggattgcttgagctcaggagttcgagaccagtctgggcaacatgttgagacctccatctgtgccccccaaaaatacaaaaattagctgggcgtggtggcgtgtgcctgtagtctacttgggaggctgaggtgggagatcacttgagcctaagcagtcgcggctgcagtgaacaagatcgcgccactgcactccaccctgggtaacggaacaagaccctgtctcaaaaaaaaaaaagaaa

SEQ ID NO: 192447 - DNA, 2472 bp, Homo sapiens
  Payload ID: 18003
  Gene Name: transducin (beta)-like 3
  ENST ID: ENST00000615855
  CDS Start-End: 399-1955
cggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaagtggcctcgggggccgtgctgcggagtctggagcaggaggaccaggaggacatcactgcctttgacctcagccctgacaacgaggtgctggtgacagccagtcgggcattgctgctggctcagtgggcctggcaagagggcagcgttacccgcctgtggaaggcgatacacacggcccccgtggccaccatggccttcgaccccacctccactctgctagccacaggtggctgtgatggggccgtgcgcgtctgggacatcgtgcggcactacgggacacaccacttccgaggctcgcccggtgtcgtgcacctagtggccttccacccggaccctacacgcctgctgctcttctcctcggccacggatgccgccatccgcgtgtggtcactgcaggaccggtcatgcctggctgtgctgactgcccactacagcgccgtcacctcactggccttcagcgccgacggccacaccatgctcagctccggccgtgacaagatatgtatcatctgggaccttcagagctgccaggccacgaggaccgtgcctgtgtttgagagcgtggaggctgctgtgctgttgccagaggagccagtgtcccagctgggtgtgaagtccccagggctgtactttctgacagctggcgaccaaggcactctgcgcgtgtgggaggcagcttctgggcagtgtgtgtacacgcaggcccagccgccgggccctgggcaggagctgacccactgcaccctggcacacaccgccggcgtggtcctcaccgccaccgccgaccacaacctgttgctctacgaggctcgctccctgcggctgcagaaacagttcgctggctacagtgaggaggttttggatgtccggtttcttgggcccgaggactcccacgttgtcgtggcctccaatagcccctgcctaaaagtgtttgagctgcagacgtcagcctgccagatcctccacggccacacggatatcgtcctggccctggatgtgttccggaaggggtggctctttgccagctgtgccaaggatcagagcgtccgtatctggagaatgaacaaggctggccaggtgatgtgcgtggctcagggttccggtcacacacacagtgtgggcaccgtctgctgctctaggctgaaggagtccttcctggtgacaggcagccaggactgcactgtgaagctgtggcctcttcccaaagccttgctgtccaagaacacagccccagacaacggccctatcctcctgcaggcccagaccactcagcgctgccatgataaggacatcaacagcgtggctattgcccccaacgacaagctgctggccacaggctcacaggaccgcacggccaagctctgggccctgccacagtgccagctgctgggtgtcttctcaggccaccgggtggcctctggtgcgtccagttctctcccatggaccaggtgctggccacggcctcagctgatggcaccatcaagctctgggcactccaggacttcagctgtctcaagacatttgaggggcacgatgctttgtctgaaggtggcctttgtgagccgtggcacgcagctgctgtccagcggttcggatggcctcgtgaagctctggaccatcaagaacaacgagtgtgtgcggacgctggatgcccacgaggacaaggtctgggggctgcacgccggctggacgaccacgccctcactggggccagtgactcccgagtcatcctctggaaggatgtgaccgaggcggagcaggcagaggagcaggccaggcaagaggagcaggtggtcaggcagcaagagctggacaacctgctgcatgagaagcggtacctgcgggcgctgggcctggccatctccctggatcggccccacaccgtgctgactgtcatccaggccatccggagggaccctgaggcctgcgagaagctggaagccaccatgctccgactgcggcgcgaccagaaaggccctgctgcgcttctgcgtcacgtggaacaccaactcgcggcactgccacgaggcccaggccgtgctgggtgtgctcttgaggcgagaggcccccgaggagctgctggcctacgaaggcgtgcgggcagcgcttgaggccctgctgccctacactgagcggcactttcagcggctcagcaggaccctccaggccgccgctttcttggacttcctgtggcacaacatgaagctccctgtgccggccgccgcccccaccccctgggaaacccataaaggcgcactgccct

SEQ ID NO: 192448 - DNA, 1115 bp, Homo sapiens
  Payload ID: 18004
  Gene Name: transducin-like enhancer of split 1 (E(sp1) homolog, Drosophila)
  ENST ID: ENST00000376463
  CDS Start-End: 79-513
gaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagaggtgagaggccgggcaagccagattaggactttgtcctcatactcttacagtgctgcaaagttgtgtgcatcgctaaagagagccccaacctatacagagagcaaacaatgagataagaggaactgtcgcaaagctttccactgaaacacaggtcaccctggaagtttgcagggtttgctgtgggcatctgtagatttctcgatctcgttagattgcaggcatcttgacatcttggcaactgcctagttaatgccagtggcctgtaccatattatggaaaactgttaactgcttaattgggtaattttcaaagaaagtaatgttgttaaatggggcgaaataagaagttaaatttgaaagtgaatgtgttcaaatgaaaggtttgataattgcatctgttactacttagtttcataggctttaattctagtatgcattaaatattgggcaaaattgcacttgactaattttttgaagaaaagtaatttattctgtcaagaaataaaaaaataggctttgtgtatggttaaactgtaaatcttatgtttacaaaatactgtaattttcaggaaatcactgtattaggaatgtgcaatgacttatataaataaaagccatttttaaaactg

SEQ ID NO: 192449 - DNA, 2350 bp, Homo sapiens
  Payload ID: 18004
  Gene Name: transducin-like enhancer of split 1 (E(sp1) homolog, Drosophila)
  ENST ID: ENST00000376472
  CDS Start-End: 27-2336
acagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagcccgcggccgccgtggtggctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggt

SEQ ID NO: 192450 - DNA, 666 bp, Homo sapiens
  Payload ID: 18004
  Gene Name: transducin-like enhancer of split 1 (E(sp1) homolog, Drosophila)
  ENST ID: ENST00000376484
  CDS Start-End: 59-442
gcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaaccgagccttgttcctgccccagcacattgagaagtttggaaacgtgtaattgatagaggaagttaggtcctagaactcagaatcttaaatgttgactttggctggaatacttcctcatttatcaacttaggtcatctgtttcttgttttctttgcttgtaatcttcttttacatatccattttaagaagttttgtatttgcctttaaaaaaaataaatgaaaatagagtgtatgcctctaaataaggaaacaaa

SEQ ID NO: 192451 - DNA, 3893 bp, Homo sapiens
  Payload ID: 18004
  Gene Name: transducin-like enhancer of split 1 (E(sp1) homolog, Drosophila)
  Uniprot ID: Q04724
  ENST ID: ENST00000376499
  CDS Start-End: 1066-3378
tttgcccgccggggagggtggccgattggcggagcgcactcctgctgttttccccaccatctcgtggatgtcgtccctcgggtggtgagagaactttgcagtgggctggagcgccctttgcggagaagcacacgaaggtgaaggaaggaaagaaagaagaccgaggaagaaggagctcggaagaagggtccggagcggccggtccggccgtgcagggcgagtgcgcccgaggcgcggcgccctgatgctccccgggctcgaggagcattgggcacttgcgggactgctctcggtggagtagccccgtcgggcccggagggtttgtgcaaccgcggagaacaccgagtgctggtcgcacggggcgtgccgagccgcctcccggcgcgccctccgcactttccccgcctcgtcatccgtcgctccccggccaggagcctccgctgcgtcttcaacctcgctcccctttgcgtcccgggagcctgcgagcacccggccgaaggcgcagccgaatcttgcgggagtcgccccgaaagcgtcgggtttgtgtggggttagcgggggccgccgcgccacctgcacctcgcccgccgccgcctcggggaaagcccgaagaggaggcggaccaggagaagagcaaagaaaagcagtccgtctggatttgtttgcccaggactggcgccgcgcacgcggatcgccgaggggagtgcggtcggagtcaccgcgcccccgcctccccgcccgggcagctgaggccgggggttggagcgctgcccccgcgcacagtccccgagcgcccgacgtctccgcgcaggttcttgaagcagctgggcctggggcgcccactaatgtggccctgagggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcgggcagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataaggactccagccactatgacagtgatggtgacaaaagcgatgacaacttagttgtggatgtgtctaatgaggacccttcttctccgcgagcaagccctgcccactcgccccgggaaaatggaatcgacaaaaatcgcctgctaaagaaggatgcttctagcagtccagcttccacggcctcctcggcaagttccacttctttgaaatccaaagaaatgagcttgcatgaaaaagccagcacgcctgttctgaaatccagcacaccaacgcctcggagcgacatgccaacgccgggcaccagcgccactccaggcctccgtccaggtctcggcaagcctccagccatagaccccctcgttaaccaagcggcagctggcttgaggacacccctggcagtgcccggcccatatcctgctccttttgggatggtcccccacgctggcatgaacggcgagctgaccagcccaggcgctgcctacgccagtttacacaacatgtcgccccagatgagcgccgcagccgccgcggccgccgtggtggcctacgggcgctcccccatggtggggtttgatcctccccctcacatgagagtacctaccattcctccaaacctggcaggaatccctggggggaaacctgcatactccttccacgttactgcagacggtcagatgcagcctgtcccttttccccccgacgccctcatcggacccggaatcccccggcatgctcgccagatcaacaccctcaaccacggggaggtggtgtgcgctgtgaccatcagcaaccccacgagacacgtgtacacaggcgggaagggctgcgtcaaggtctgggacatcagccaccctggcaataagagccctgtctcccagctcgactgtctgaacagagacaattatatccgttcctgtaaattgctacccgatggctgcactctcatagtgggaggggaagccagtactttgtccatttgggacctggcggctccaaccccgcgcatcaaggcggagctgacgtcctcggcccccgcctgctacgccctggccatcagccccgattccaaggtctgcttctcatgctgcagcgacggcaacatcgctgtgtgggatctgcacaaccagacactagtgaggcaattccagggccacacagacggagccagctgtattgacatttctaatgatggcaccaagctctggacgggtggtttggacaacacagtcaggtcctgggacctgcgcgaggggcggcagctgcagcagcacgacttcacctcccagatcttctccctggggtactgccccaccggggagtggctggcagtgggcatggagagcagcaatgtggaggtgctgcacgtgaacaagcctgacaagtaccagctgcacctgcatgagagctgcgtgctgtccctgaaatttgcttactgtggtaaatggtttgtgagtactggaaaagataacctcctcaatgcttggcggaccccctatggagccagcatattccagtccaaagagtcctcgtcagtgcttagctgtgacatctctgtggatgataagtacatagtcactggctcgggggacaagaaggctacagtctatgaagtcatctactgaaaacattatgtggtttaacgtttatagttgaattgggccaaaatgtttcgaatttatagaaatagaaaagttgtaactttaaaagagaaaaaaaattacaaacacctgtttccaaaccttgacagaaaactactttgagtctacaaagaggaggcgacaagtccatcagcagaaagtcacctgtctacatagaccaaatggagcaccaaggccaagcggacagaggggccatgggttgtaggattgaggaacggaatctgccgactcacatgacagcccattctttctttctgggtgatctggggatcacgccttgcccaagtgtgagattacctttctgttccttgcagttcacctcactttccgtcctttgtagagcagtggtgtctccaatgaacttgtttcctggttttgcatcttgtgaaatgtttttttgtatttttgttgaaggttaaacatttgtataaattgtaaatatatttggtttattacagtaaaggctttagtaccaataa

SEQ ID NO: 192452 - DNA, 936 bp, Homo sapiens
  Payload ID: 18004
  Gene Name: transducin-like enhancer of split 1 (E(sp1) homolog, Drosophila)
  ENST ID: ENST00000418319
  CDS Start-End: 209-936
gggccggagcccgcaccgacgggagcgggagccggagcagctgcgggcgccgagtggccggtgcgcccggcggagcgcgcgtgcgtggccagcgcgctccccgcttctgcttggctttccggcttaattttcctcggcgggattaaagttggaaattgaccggagaattgagttgccggggaacagagccccggccgccgccagagcgatgttcccgcagagccggcacccgacgccgcaccaggctgcaggccagcccttcaagttcactatcccggagtccctggaccggattaaagaggaattccagttcctgcaggcgcagtatcacagccttaaattggaatgtgagaaactggcaagtgaaaagacagaaatgcagaggcactatgtgatgtattatgaaatgtcatatggattaaacattgaaatgcacaaacagactgaaatcgccaagagattgaatacgatttgtgcacaagtcatcccatttctgtctcaggaacatcaacaacaggtggcccaggctgttgaacgtgccaaacaggtgaccatggcagaattgaatgccatcatcggggtacgtggcctaccaggtctacctcctacacagcagcagttgcaagctcagcatctttctcatggccacggacccccagttccccttacgcctcacccttcgggacttcagcctcctggaatcccgcccctcgggggcagtgccggccttcttgcgctgtctagtgctctgagtgggcagtctcacttggcaataaaagatgacaagaagcaccacgatgcagagcaccacagagacagagagccgggcacaagtaattccctcctggtcccagacagtctaagaggcacagataaacgcagaaatggacctgaattttccaatgacatcaagaaaaggaaggtggatgataagga

SEQ ID NO: 192453 - DNA, 2705 bp, Homo sapiens
  Payload ID: 18005
  Gene Name: transducin-like enhancer of split 2
  Uniprot ID: Q04725
  ENST ID: ENST00000262953
  CDS Start-End: 264-2495
tcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgca

SEQ ID NO: 192454 - DNA, 2238 bp, Homo sapiens
  Payload ID: 18005
  Gene Name: transducin-like enhancer of split 2
  Uniprot ID: Q04725
  ENST ID: ENST00000443826
  CDS Start-End: 207-2072
agaaaagccatttccgactccagactggtccccgctccccgcaagcccccccccccgctcccacgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgg

SEQ ID NO: 192455 - DNA, 2406 bp, Homo sapiens
  Payload ID: 18005
  Gene Name: transducin-like enhancer of split 2
  Uniprot ID: Q04725
  ENST ID: ENST00000426948
  CDS Start-End: 1-2121
atggtgcaatcacggctcactgcaacctccgcctcccaagattctcctgcttcaggattacagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgc

SEQ ID NO: 192456 - DNA, 2253 bp, Homo sapiens
  Payload ID: 18005
  Gene Name: transducin-like enhancer of split 2
  Uniprot ID: Q04725
  ENST ID: ENST00000455444
  CDS Start-End: 179-2044
ccccgctcgccccgcgcaccccaacccgcccccccagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcacatccgc

SEQ ID NO: 192457 - DNA, 841 bp, Homo sapiens
  Payload ID: 18005
  Gene Name: transducin-like enhancer of split 2
  ENST ID: ENST00000589364
  CDS Start-End: 1-841
cccaggagcatcagcagcaggtgctccaggccgtagaacgcgccaagcaggtcaccgtgggggagctgaacagcctcatcggggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctccca

SEQ ID NO: 192458 - DNA, 389 bp, Homo sapiens
  Payload ID: 18005
  Gene Name: transducin-like enhancer of split 2
  ENST ID: ENST00000586422
  CDS Start-End: 18-377
ccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagctccagccgctgtcccaccacgcaccccctgtgcccctcaccccccccctgcctaggaaccgtacatcccatctgctctctggccaacggcttcacaccttcccctgctgcatgtgggggccgatgggcaggggacctcggtggaaataaaatgtatctatc

SEQ ID NO: 192459 - DNA, 2344 bp, Homo sapiens
  Payload ID: 18005
  Gene Name: transducin-like enhancer of split 2
  ENST ID: ENST00000590536
  CDS Start-End: 110-2344
ctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactga

SEQ ID NO: 192460 - DNA, 393 bp, Homo sapiens
  Payload ID: 18005
  Gene Name: transducin-like enhancer of split 2
  ENST ID: ENST00000591457
  CDS Start-End: 1-393
tacagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcagagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccgg

SEQ ID NO: 192461 - DNA, 559 bp, Homo sapiens
  Payload ID: 18005
  Gene Name: transducin-like enhancer of split 2
  ENST ID: ENST00000587137
  CDS Start-End: 140-559
cccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagagtgcatctccctcgccccctgagagtctcgtggaggaggagcgaccgagtggccctggtggtggcgggaagcagagagcagatgagaaggagccatcaggaccttatgaaagcgacgaagacaag

SEQ ID NO: 192462 - DNA, 2483 bp, Homo sapiens
  Payload ID: 18005
  Gene Name: transducin-like enhancer of split 2
  Uniprot ID: Q04725
  ENST ID: ENST00000591529
  CDS Start-End: 85-2205
gaaaattgtactgagaattagaacttctgcaagggctcaagagtgtcagctagtaataataataataacaatagctgaagtgcaatggtgcaatcacggctcactgcaacctccgcctcccaagattctcctgcttcaggattacagaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcgtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatca

SEQ ID NO: 192463 - DNA, 600 bp, Homo sapiens
  Payload ID: 18005
  Gene Name: transducin-like enhancer of split 2
  ENST ID: ENST00000592584
  CDS Start-End: 66-600
gaaaagccatttccgactccagactggtccccgctccccgcaagcccccccccccgctcccacggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtgg

SEQ ID NO: 192464 - DNA, 5207 bp, Homo sapiens
  Payload ID: 18006
  Gene Name: transducin-like enhancer of split 3
  Uniprot ID: Q04726
  ENST ID: ENST00000317509
  CDS Start-End: 1103-3385
gctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattccc

SEQ ID NO: 192465 - DNA, 2356 bp, Homo sapiens
  Payload ID: 18006
  Gene Name: transducin-like enhancer of split 3
  Uniprot ID: Q04726
  ENST ID: ENST00000451782
  CDS Start-End: 47-2356
ggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaa

SEQ ID NO: 192466 - DNA, 2657 bp, Homo sapiens
  Payload ID: 18006
  Gene Name: transducin-like enhancer of split 3
  Uniprot ID: Q04726
  ENST ID: ENST00000440567
  CDS Start-End: 74-2362
atttaagcatctatcatggcagggtaaacgaggcagtttatctggcacctccattttgcttgttgctacctttatggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccac

SEQ ID NO: 192467 - DNA, 2464 bp, Homo sapiens
  Payload ID: 18006
  Gene Name: transducin-like enhancer of split 3
  ENST ID: ENST00000539550
  CDS Start-End: 70-2169
aatataacgttctgttgagatgagaggaacgctcgcccttgtcagctcttaaaccgctcttactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttacccagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccac

SEQ ID NO: 192468 - DNA, 4294 bp, Homo sapiens
  Payload ID: 18006
  Gene Name: transducin-like enhancer of split 3
  ENST ID: ENST00000557919
  CDS Start-End: 774-2111
gcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaacccgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagagg

SEQ ID NO: 192469 - DNA, 478 bp, Homo sapiens
  Payload ID: 18006
  Gene Name: transducin-like enhancer of split 3
  ENST ID: ENST00000557984
  CDS Start-End: 17-478
attatgtgatggtgagatgcggccgcgggcctggggggcggttggggcgccgaccccggccgggggcgcggcgtggatctggggagatgagcgccaggtccccaccaccgcccagccgcagggcggccctgagagagggcataatctggtcttgccctccccttccccagcttccattgccggggccacttggaggaggtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatc

SEQ ID NO: 192470 - DNA, 6004 bp, Homo sapiens
  Payload ID: 18006
  Gene Name: transducin-like enhancer of split 3
  Uniprot ID: Q04726
  ENST ID: ENST00000558939
  CDS Start-End: 1379-3697
tataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctccccccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaa

SEQ ID NO: 192471 - DNA, 2766 bp, Homo sapiens
  Payload ID: 18006
  Gene Name: transducin-like enhancer of split 3
  ENST ID: ENST00000558201
  CDS Start-End: 135-2471
ggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccac

SEQ ID NO: 192472 - DNA, 3021 bp, Homo sapiens
  Payload ID: 18006
  Gene Name: transducin-like enhancer of split 3
  ENST ID: ENST00000560939
  CDS Start-End: 399-2723
cattttgcttgttgctacctttatggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaga

SEQ ID NO: 192473 - DNA, 3408 bp, Homo sapiens
  Payload ID: 18006
  Gene Name: transducin-like enhancer of split 3
  ENST ID: ENST00000559929
  CDS Start-End: 54-2402
cggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttacccagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaagga

SEQ ID NO: 192474 - DNA, 3683 bp, Homo sapiens
  Payload ID: 18006
  Gene Name: transducin-like enhancer of split 3
  Uniprot ID: Q04726
  ENST ID: ENST00000557997
  CDS Start-End: 1091-3385
gttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaga

SEQ ID NO: 192475 - DNA, 2295 bp, Homo sapiens
  Payload ID: 18006
  Gene Name: transducin-like enhancer of split 3
  Uniprot ID: Q04726
  ENST ID: ENST00000557907
  CDS Start-End: 1-2295
atgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaa

SEQ ID NO: 192476 - DNA, 3647 bp, Homo sapiens
  Payload ID: 18006
  Gene Name: transducin-like enhancer of split 3
  ENST ID: ENST00000560525
  CDS Start-End: 1-1835
gcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgatagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtga

SEQ ID NO: 192477 - DNA, 3719 bp, Homo sapiens
  Payload ID: 18006
  Gene Name: transducin-like enhancer of split 3
  ENST ID: ENST00000561453
  CDS Start-End: 1120-2466
agtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaacccgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaga

SEQ ID NO: 192478 - DNA, 2304 bp, Homo sapiens
  Payload ID: 18006
  Gene Name: transducin-like enhancer of split 3
  Uniprot ID: Q04726
  ENST ID: ENST00000558379
  CDS Start-End: 1-2304
atgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaa

SEQ ID NO: 192479 - DNA, 2918 bp, Homo sapiens
  Payload ID: 18006
  Gene Name: transducin-like enhancer of split 3
  Uniprot ID: Q04726
  ENST ID: ENST00000559048
  CDS Start-End: 302-2620
aattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacaga

SEQ ID NO: 192480 - DNA, 1575 bp, Homo sapiens
  Payload ID: 18006
  Gene Name: transducin-like enhancer of split 3
  ENST ID: ENST00000559191
  CDS Start-End: 253-1314
cttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctcgccgccgccgctgctgcagccgctgcctatggccgatcgccaatggttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatag

SEQ ID NO: 192481 - DNA, 3509 bp, Homo sapiens
  Payload ID: 18006
  Gene Name: transducin-like enhancer of split 3
  ENST ID: ENST00000560589
  CDS Start-End: 353-2503
ccgaatgagggtctaggtcgcggcgagcgggttcactccgggttctgggtgtcgggagccagcgtcagggtcctactcccctgctgccgtgataagtcctttggctcgcgggaagtttcgaattgtttcacatccccctccccacggcggggacccaaatccccccgcgtccccaggctgtgggataatgggggcgcccccgggggggtgtcaggaaagtggaaaagtggctctagaggcccttgggtcggggcctcagaggaggctgtccaggcgccacgcctgagccggctcctcctgccctcgcagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaagga

SEQ ID NO: 192482 - DNA, 457 bp, Homo sapiens
  Payload ID: 18006
  Gene Name: transducin-like enhancer of split 3
  ENST ID: ENST00000537387
  CDS Start-End: 1-120
gtggcgcaggcagtggagcgcgccaagcaggtcaccatgacggagctgaacgccatcatcgggataaggaaatttgaggctccaggacttgaagtaacctgccccaggccacacagctaggaagtgccagagctgggatttcaatcctgttctgtctagttccaaagcctccactcttccagttaccccgttttccaccactgatgtccggtgacgttagctctcattccactggcccccagctcatctggctctggggcctttgctgtgatgacctgccctgcccctgctctgtaaggcaggcttggagttcctaagaaataaggagccttccccagggtccagcctcagggtggaagatgctggcagctaatgctgaaggcatcagcagctccaggcgcagcacctctcccatgccacacacggccccccggtccagttgccaccccacccgtca

SEQ ID NO: 192483 - DNA, 495 bp, Homo sapiens
  Payload ID: 18006
  Gene Name: transducin-like enhancer of split 3
  ENST ID: ENST00000560996
  CDS Start-End: 186-495
tgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcggggtacgtggactccccaatctgcctcttacccagcagcagctccaggcgcagcacctctcccatgccacacacggccccccggtccagttgccaccccacccgtcag

SEQ ID NO: 192484 - DNA, 5742 bp, Homo sapiens
  Payload ID: 18006
  Gene Name: transducin-like enhancer of split 3
  ENST ID: ENST00000627388
  CDS Start-End: 1120-3438
agtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagaggtgcggctgggctggggaataactctgtgtcaccctcggaaagcctccgggccagtgagaagcaccggggctctgcggactacagcatggaagccaagaagcggaaggcggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctgaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggcaagtggttcgtgagcactgggaaagataaccttctcaacgcctggaggacgccttatggagccagcatattccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggcttttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctccccccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcg

SEQ ID NO: 192485 - DNA, 2382 bp, Homo sapiens
  Payload ID: 18007
  Gene Name: transducin-like enhancer of split 4
  Uniprot ID: Q04727
  ENST ID: ENST00000265284
  CDS Start-End: 47-2293
atgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaa

SEQ ID NO: 192486 - DNA, 2793 bp, Homo sapiens
  Payload ID: 18007
  Gene Name: transducin-like enhancer of split 4
  Uniprot ID: Q04727
  ENST ID: ENST00000376537
  CDS Start-End: 177-2594
gccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaa

SEQ ID NO: 192487 - DNA, 4871 bp, Homo sapiens
  Payload ID: 18007
  Gene Name: transducin-like enhancer of split 4
  Uniprot ID: Q04727
  ENST ID: ENST00000376544
  CDS Start-End: 1019-3133
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttataatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagtatgcttatttttctaattctttgtcttgatgacattagtttattttttatctttggctgtgccactcctatatattaaaaatgcctagttttttcaagggagattgttgttaaagtaaagtggttttttttgttgttaaa

SEQ ID NO: 192488 - DNA, 3695 bp, Homo sapiens
  Payload ID: 18007
  Gene Name: transducin-like enhancer of split 4
  Uniprot ID: Q04727
  ENST ID: ENST00000376552
  CDS Start-End: 1019-3340
ggagagctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataa

SEQ ID NO: 192489 - DNA, 565 bp, Homo sapiens
  Payload ID: 18007
  Gene Name: transducin-like enhancer of split 4
  ENST ID: ENST00000414465
  CDS Start-End: 181-565
agccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatg

SEQ ID NO: 192490 - DNA, 632 bp, Homo sapiens
  Payload ID: 18007
  Gene Name: transducin-like enhancer of split 4
  ENST ID: ENST00000417836
  CDS Start-End: 1-632
ggagcccagcacattcccccagagagaatggcctagacaagacacgcctgctcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaa

SEQ ID NO: 192491 - DNA, 967 bp, Homo sapiens
  Payload ID: 18007
  Gene Name: transducin-like enhancer of split 4
  ENST ID: ENST00000428713
  CDS Start-End: 1-967
gcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttgg

SEQ ID NO: 192492 - DNA, 656 bp, Homo sapiens
  Payload ID: 18007
  Gene Name: transducin-like enhancer of split 4
  ENST ID: ENST00000425506
  CDS Start-End: 71-656
gggcgaacgaacgagccgagagggtggcggccgcctccctcctcccccggcctgaccgcagcccgacgccatggcgcgggtccccccgacgggccagtttcgattccgggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagag

SEQ ID NO: 192493 - DNA, 873 bp, Homo sapiens
  Payload ID: 18007
  Gene Name: transducin-like enhancer of split 4
  ENST ID: ENST00000435650
  CDS Start-End: 200-873
ggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattggggagaaaaagaataaaagtgacacacctggatcattaaagcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagaggtgaacagagactccatcaagagctcttcagtatccccat

SEQ ID NO: 192494 - DNA, 1028 bp, Homo sapiens
  Payload ID: 18007
  Gene Name: transducin-like enhancer of split 4
  ENST ID: ENST00000496114
  CDS Start-End: 1-1028
agccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccgaccaaatgcttttaccacctgagggctttccctggaaatgaactggagatggaactgccaagagatactcacagagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcg

SEQ ID NO: 192495 - DNA, 2832 bp, Homo sapiens
  Payload ID: 18007
  Gene Name: transducin-like enhancer of split 4
  ENST ID: ENST00000470872
  CDS Start-End: 217-489
cgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcagagactgtttttcacaaattgaaggctgtagcaaccctgaatggagctgttcttccaatagcctgtgctcacttcgtgtctctgtgtcacattttggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaa

SEQ ID NO: 192496 - DNA, 2814 bp, Homo sapiens
  Payload ID: 18007
  Gene Name: transducin-like enhancer of split 4
  ENST ID: ENST00000462803
  CDS Start-End: 167-946
gttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagcaaaactacttgctgctcataatggatgaaattggagaccaaagaggaagaaccttctgggttcctgtcagtctaaatcctgattttaaaagacattcacctgccatgctagtgttgtgtgcttctactgagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgatacc

SEQ ID NO: 192497 - DNA, 717 bp, Homo sapiens
  Payload ID: 18007
  Gene Name: transducin-like enhancer of split 4
  ENST ID: ENST00000490347
  CDS Start-End: 1-717
caacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcacca

SEQ ID NO: 192498 - DNA, 1536 bp, Homo sapiens
  Payload ID: 18007
  Gene Name: transducin-like enhancer of split 4
  ENST ID: ENST00000461758
  CDS Start-End: 851-1156
tttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccagcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggtaagttatttctttataaccattttaaatgacagtaatactgggacactatgaaaagaaaattgtatgttttgcagttttattctgcaagccgttgtggctacctttgctttatgtattttgggcattgcaaacttgtcttgtgaaagagcttttcttggaaaatattaaacagtaaaattaaattgtgtggcgccttcgttggcttgatgtgaaagaatggatagagggtgagctgggaggatgaaaatgaaatctgtggagctacaaaagaaattgatgtaaaatccttgtactggtcccctgaggctacttagttgggtcttaccaagaactataaccgttacttccaaaatttgtacagagtaaatgagcctgataggaggatgtgataaggttcaacattgggtcttgaaatctagcaattagttcag

SEQ ID NO: 192499 - DNA, 497 bp, Homo sapiens
  Payload ID: 18007
  Gene Name: transducin-like enhancer of split 4
  ENST ID: ENST00000467142
  CDS Start-End: 1-497
agctcttcagtatccccatcagccagtttccgaggtgctgagaagcacagaaactccgcagactactcctcagagagcaaaaagcagaaaactgaagaaaaggaaattgcagctcgttataatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaa

SEQ ID NO: 192500 - DNA, 2100 bp, Homo sapiens
  Payload ID: 18008
  Gene Name: transducin-like enhancer of split 6
  Uniprot ID: Q9H808
  ENST ID: ENST00000246112
  CDS Start-End: 202-1920
attgatctgcttcgcggtccaggtggcggctgggtggggcctgggcgggacggggcggggacaaggcgggacgaggcggggcccgatgggtcaaatggcccccggtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggcagagtg

SEQ ID NO: 192501 - DNA, 1883 bp, Homo sapiens
  Payload ID: 18008
  Gene Name: transducin-like enhancer of split 6
  Uniprot ID: Q9H808
  ENST ID: ENST00000452088
  CDS Start-End: 359-1708
gaacttggctgacctccgcagcttccgcccggtgagggacccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggca

SEQ ID NO: 192502 - DNA, 582 bp, Homo sapiens
  Payload ID: 18008
  Gene Name: transducin-like enhancer of split 6
  ENST ID: ENST00000453329
  CDS Start-End: 119-582
aaatggcccccggtgggggaaggaggagtttcctcttggcctgaacttggctgacctccgcagcttccgcccggtgagggacactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttg

SEQ ID NO: 192503 - DNA, 456 bp, Homo sapiens
  Payload ID: 18008
  Gene Name: transducin-like enhancer of split 6
  ENST ID: ENST00000482627
  CDS Start-End: 98-235
gtgggggaaggaggagtttcctcttggcctgaacttggctgacctccgcagcttccgcccgactctggctaaagtcttggaggctactgccttgaagatgacctctagggaccagcccagacccaagggccccccgaaaagcacttcgccttgtcctgggatctcgaactctgagagctctccgacgctgaattatcagggcattctaaatcggctcaagcagttccccaggtgagagcaattccaggggccggaggtctcacgctgggaaggagccccacctggcctctctcccgggggtcctagtgagtggtctagaggctgctggcccaagagccaggctcaggaacaggaagccatgcagatacccagcatggagaacccggcaatacccatcccagcttttgattaaacaaaattaccaacaaatattaaaattttgattttcctgttcga

SEQ ID NO: 192504 - DNA, 1880 bp, Homo sapiens
  Payload ID: 18008
  Gene Name: transducin-like enhancer of split 6
  ENST ID: ENST00000617937
  CDS Start-End: 359-1609
gaacttggctgacctccgcagcttccgcccggtgagggacccttgtcctgggatctcgaactctgagagctctccgacgctgaattatcagggcattctaaatcggctcaagcagttccccaggttttctcctcattttgctgcggagttggagagcatttactactcgctgcacaagatccagcaggatgtggcagaacatcacaagcagataggaaacgtcttacagattgtggagagctgcagccaactccagggtttccagtctgaggaggtctcacctgctgaaccagccagccctgggacgccccagcaggtgaaggacaagaccctgcaggagtcgagctttgaggacatcatggccaccaggtcctccgactggctccggcggcctttgggggaggacaatcagccggagacccagctgttctgggacaaggagccttggttttggcacgacactctgaccgagcaactctggcggatttttgccggcgtccacgatgagaaggcaaagcccagagacagacagcaggcaccaggcctggggcaggaaagcaaggcaccaggatcctgtgacccaggaacagacccatgtcctgaagatgcctccacccccaggccacctgaggcctcctccagtccccctgagggttcccaagacaggaacacaagttggggtgtggtccaggagcctcctggaagagcctctcggtttctacagtccatatcctgggaccctgaggactttgaagatgcatggaagaggccagatgccttgcccgggcagtcaaagagactcgccgtcccgtgcaaactggaaaagatgcggatcttggcacacggggagctcgtgctcgccacggccatcagcagcttcacgcggcacgtgttcacctgtggcagaagaggcatcaaggtgtggagcctgactggacaggtggctgaggacaggttccctgagagccacctgcctatacagacccctggggccttcctgcgcacctgcctgctgtcctcaaacagcaggagcctgctcaccggtggctacaacctggccagcgtgagcgtgtgggacctggcggcgccctccctgcatgtgaaggagcagttgccctgtgcaggtctcaactgccaggccctggatgccaacctggatgccaacctggccttcgccagcttcaccagtggtgtggtcaggatctgggacctgcgggatcagagtgtggtcagggacctcaagggttatcctgatggagtcaagagtatcgtggtcaagggctacaacatctggactgggggtccggatgcctgtctgcggtgctgggaccagaggaccatcatgaaacctctggagtaccaattcaagtctcagataatgagcctgtcccacagcccccaggaggactgggtgctgctgggcatggccaatggccagcagtggctgcaaagcaccagcgggagccagcggcacatggtggggcaaagacagcgtcatcctgagcgtcaagttctccccctttggccagtggtgggcaagcgttggaatggacgacttccttggcgtctacagcatgccggcggggacaaaagtgttcgaggtgcctgagatgtctccagtcacgtgctgtgacgtctcttccaacaaccgcctcgttgtcacaggctccggggagcacgcctccgtgtaccagatcacctactgaggggcctcgctgctgtcatcccactccggctcctcttttcatccccccccttccccccccccaacaagggggacatggtggagggaagcgggaaggctcttctgtggcatcgcacgatctagtctgtggtgtagactggtcgccatcacgtgtaataaagcacccgggaaaggc

SEQ ID NO: 192505 - DNA, 2968 bp, Homo sapiens
  Payload ID: 18009
  Gene Name: transferrin
  Uniprot ID: P02787
  ENST ID: ENST00000402696
  CDS Start-End: 486-2582
gggctttgcctgtcattctgcagttctagtgtggggtctgggcgcagttcttttccctctccagcctcggagtcttcctctgtggactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccgggaatggaataaagggacgcggggcgccggaggctgcacagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgta

SEQ ID NO: 192506 - DNA, 546 bp, Homo sapiens
  Payload ID: 18009
  Gene Name: transferrin
  ENST ID: ENST00000414694
  CDS Start-End: 49-396
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgcca

SEQ ID NO: 192507 - DNA, 526 bp, Homo sapiens
  Payload ID: 18009
  Gene Name: transferrin
  ENST ID: ENST00000466911
  CDS Start-End: 300-526
gactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggt

SEQ ID NO: 192508 - DNA, 594 bp, Homo sapiens
  Payload ID: 18009
  Gene Name: transferrin
  ENST ID: ENST00000494430
  CDS Start-End: 49-411
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacgga

SEQ ID NO: 192509 - DNA, 580 bp, Homo sapiens
  Payload ID: 18009
  Gene Name: transferrin
  ENST ID: ENST00000485977
  CDS Start-End: 49-357
acagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatca

SEQ ID NO: 192510 - DNA, 659 bp, Homo sapiens
  Payload ID: 18009
  Gene Name: transferrin
  ENST ID: ENST00000482271
  CDS Start-End: 257-659
acagaagcgagtccgactgtgctcgctgctcagcgccgcacccggaagatgaggctcgccgtgggagccctgctggtctgcgccgtcctgggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccact

SEQ ID NO: 192511 - DNA, 990 bp, Homo sapiens
  Payload ID: 18009
  Gene Name: transferrin
  ENST ID: ENST00000461695
  CDS Start-End: 1-431
ggtattttgctatagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactggggagacaatacagaaaagaagaggcaaaggggccgagatgggatacagacctgtatcacacaggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgatt

SEQ ID NO: 192512 - DNA, 5111 bp, Homo sapiens
  Payload ID: 18010
  Gene Name: transferrin receptor
  Uniprot ID: P02786
  ENST ID: ENST00000360110
  CDS Start-End: 171-2453
ctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactga

SEQ ID NO: 192513 - DNA, 5032 bp, Homo sapiens
  Payload ID: 18010
  Gene Name: transferrin receptor
  Uniprot ID: P02786
  ENST ID: ENST00000392396
  CDS Start-End: 284-2566
agagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggata

SEQ ID NO: 192514 - DNA, 4814 bp, Homo sapiens
  Payload ID: 18010
  Gene Name: transferrin receptor
  ENST ID: ENST00000420415
  CDS Start-End: 117-2156
cctcagagcgtcgggatatcgggtggcggctcgggacggaggacgcgctagtgttcttctgtgtggcagttcagaatgatggatcaagctagatcagcattctctaacttggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagtagcatacatttataatgtttgctattgacaagtcattttaactttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcattataaacgtgatgatcagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagatgggccttttggaggtaaaggataaaatgaatgagttctgtcatgattcactattctagaacttgcatgacctttactgtgttagctctttgaatgttcttgaaattttagactttctttgtaaacaaatgatatgtccttatcattgtataaaagctgttatgtgcaacagtgtggagattccttgtctgatttaataaaatacttaaacactga

SEQ ID NO: 192515 - DNA, 524 bp, Homo sapiens
  Payload ID: 18010
  Gene Name: transferrin receptor
  ENST ID: ENST00000421258
  CDS Start-End: 78-323
cccctcagagcgtcgggatatcgggtggcggctcgggacggaggacgcgctagtgttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggaga

SEQ ID NO: 192516 - DNA, 354 bp, Homo sapiens
  Payload ID: 18010
  Gene Name: transferrin receptor
  ENST ID: ENST00000426789
  CDS Start-End: 1-354
gcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagaaggtccacagatgatgctccttctcacggatgcgaggccatcaaatcactttttgtctccgctgctctctctccat

SEQ ID NO: 192517 - DNA, 2888 bp, Homo sapiens
  Payload ID: 18011
  Gene Name: transferrin receptor 2
  Uniprot ID: Q9UP52
  ENST ID: ENST00000223051
  CDS Start-End: 42-2447
cgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagcca

SEQ ID NO: 192518 - DNA, 2631 bp, Homo sapiens
  Payload ID: 18011
  Gene Name: transferrin receptor 2
  ENST ID: ENST00000431692
  CDS Start-End: 42-1109
cgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataagcca

SEQ ID NO: 192519 - DNA, 2196 bp, Homo sapiens
  Payload ID: 18011
  Gene Name: transferrin receptor 2
  ENST ID: ENST00000490084
  CDS Start-End: 1-509
actacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggctggagtgcagtggtgcaatcttggctcactgcaacctccacctcccgggttcaagtgattcttctgcctcagactccagagtatctaggattacaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 192520 - DNA, 3131 bp, Homo sapiens
  Payload ID: 18011
  Gene Name: transferrin receptor 2
  Uniprot ID: Q9UP52
  ENST ID: ENST00000462107
  CDS Start-End: 289-2694
cacgcctgagcaccccaggacctgcgctcagggaggaggcaggcgtggggctgtggagagattggcaggggagagcacagccccttgtgctctggcctggacccgggggccacgtctggaaggctggactgaggccaggactgtgcccccacccttgggggtggtgaggagcagccttggttcaggctgcctgccaggactgataaggggccctcctagggctcccacaaacggtttatcggtttatcgctgggggacagcctgcaggcttcaggaggggacacaagcatggagcggctttggggtctattccagagagcgcaacaactgtccccaagatcctctcagaccgtctaccagcgtgtggaaggcccccggaaagggcacctggaggaggaagaggaagacggggaggagggggcggagacattggcccacttctgccccatggagctgaggggccctgagcccctgggctctagacccaggcagccaaacctcattccctgggcggcagcaggacggagggctgccccctacctggtcctgacggccctgctgatcttcactggggccttcctactgggctacgtcgccttccgagggtcctgccaggcgtgcggagactctgtgttggtggtcagtgaggatgtcaactatgagcctgacctggatttccaccagggcagactctactggagcgacctccaggccatgttcctgcagttcctgggggaggggcgcctggaggacaccatcaggcaaaccagccttcgggaacgggtggcaggctcggccgggatggccgctctgactcaggacattcgcgcggcgctctcccgccagaagctggaccacgtgtggaccgacacgcactacgtggggctgcaattcccggatccggctcaccccaacaccctgcactgggtcgatgaggccgggaaggtcggagagcagctgccgctggaggaccctgacgtctactgcccctacagcgccatcggcaacgtcacgggagagctggtgtacgcccactacgggcggcccgaagacctgcaggacctgcgggccaggggcgtggatccagtgggccgcctgctgctggtgcgcgtgggggtgatcagcttcgcccagaaggtgaccaatgctcaggacttcggggctcaaggagtgctcatatacccagagccagcggacttctcccaggacccacccaagccaagcctgtccagccagcaggcagtgtatggacatgtgcacctgggaactggagacccctacacacctggcttcccttccttcaatcaaacccagttccctccagttgcatcatcaggccttcccagcatcccagcccagcccatcagtgcagacattgcctcccgcctgctgaggaagctcaaaggccctgtggccccccaagaatggcaggggagcctcctaggctccccttatcacctgggccccgggccacgactgcggctagtggtcaacaatcacaggacctccacccccatcaacaacatcttcggctgcatcgaaggccgctcagagccagatcactacgttgtcatcggggcccagagggatgcatggggcccaggagcagctaaatccgctgtggggacggctatactcctggagctggtgcggaccttttcctccatggtgagcaacggcttccggccccgcagaagtctcctcttcatcagctgggacggtggtgactttggaagcgtgggctccacggagtggctagagggctacctcagcgtgctgcacctcaaagccgtagtgtacgtgagcctggacaacgcagtgctgggggatgacaagtttcatgccaagaccagcccccttctgacaagtctcattgagagtgtcctgaagcaggtggattctcccaaccacagtgggcagactctctatgaacaggtggtgttcaccaatcccagctgggatgctgaggtgatccggcccctacccatggacagcagtgcctattccttcacggcctttgtgggagtccctgccgtcgagttctcctttatggaggacgaccaggcctacccattcctgcacacaaaggaggacacttatgagaacctgcataaggtgctgcaaggccgcctgcccgccgtggcccaggccgtggcccagctcgcagggcagctcctcatccggctcagccacgatcgcctgctgcccctcgacttcggccgctacggggacgtcgtcctcaggcacatcgggaacctcaacgagttctctggggacctcaaggcccgcgggctgaccctgcagtgggtgtactcggcgcggggggactacatccgggcggcggaaaagctgcggcaggagatctacagctcggaggagagagacgagcgactgacacgcatgtacaacgtgcgcataatgcgggtggagttctacttcctttcccagtacgtgtcgccagccgactccccgttccgccacatcttcatgggccgtggagaccacacgctgggcgccctgctggaccacctgcggctgctgcgctccaacagctccgggacccccggggccacctcctccactggcttccaggagagccgtttccggcgtcagctagccctgctcacctggacgctgcaaggggcagccaatgcgcttagcggggatgtctggaacattgataacaacttctgaggccctggggatcctcacatccccgtcccccagtcaagagctcctctgctcctcgcttgaatgattcagggtcagggaggtggctcagagtccacctctcattgctgatcaatttctcattacccctacacatctctccacggagcccagaccccagcacagatatccacacaccccagccctgcagtgtagctgaccctaatgtgacggtcatactgtcggttaatcagagagtagcatcccttcaatcacagccccttcccctttctggggtcctccatacctagagaccactctgggaggtttgctaggccctgggacctggccagctctgttagtgggagagatcgctggcaccatagccttatggccaacaggtggtctgtggtgaaaggggcgtggagtttcaatatcaataaaccacctgatatcaataa

SEQ ID NO: 192521 - DNA, 12590 bp, Homo sapiens
  Payload ID: 18012
  Gene Name: transformation/transcription domain-associated protein
  Uniprot ID: Q9Y4A5
  ENST ID: ENST00000355540
  CDS Start-End: 210-11702
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 192522 - DNA, 12677 bp, Homo sapiens
  Payload ID: 18012
  Gene Name: transformation/transcription domain-associated protein
  Uniprot ID: Q9Y4A5
  ENST ID: ENST00000359863
  CDS Start-End: 210-11789
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccagggtaaaccgacctggtccggcatgcattcatcatcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 192523 - DNA, 11654 bp, Homo sapiens
  Payload ID: 18012
  Gene Name: transformation/transcription domain-associated protein
  ENST ID: ENST00000456197
  CDS Start-End: 1-10766
aaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgaagctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaagcatttccgagtgcgggagatgtcccttgtctccattctgtcagtttgagcctgccatggaaggggtagaggaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 192524 - DNA, 550 bp, Homo sapiens
  Payload ID: 18012
  Gene Name: transformation/transcription domain-associated protein
  ENST ID: ENST00000417523
  CDS Start-End: 336-550
aggcctctctccatccagttttgatggaggtagctctgcctgccatgtggatccagcctcggagggtctcggtccatctccagccgtcaccttcccaaagaccctcctggcctcctctccattctgcgggccgagaagaaccccaggagagcagcggggaccgggagcgaggagtgggggtggcaaaccctaccctgcctgccaccttcagtccagtggtggacaatacctggaccccatagctgccaactcgggaagccgcgcccccccccaggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatt

SEQ ID NO: 192525 - DNA, 12492 bp, Homo sapiens
  Payload ID: 18012
  Gene Name: transformation/transcription domain-associated protein
  ENST ID: ENST00000446306
  CDS Start-End: 62-11608
gctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcagcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaag

SEQ ID NO: 192526 - DNA, 12644 bp, Homo sapiens
  Payload ID: 18012
  Gene Name: transformation/transcription domain-associated protein
  ENST ID: ENST00000628380
  CDS Start-End: 210-11756
cgcgccggggcctggtgctcggtcggcgggtgctgccgctttaagcgggggcgggactgcgcgcggccgagcggttgcgacgagggctcggctgggggtcgccggggtcgcgggccgggcctgcaggagccgggccgccgaggtcggggctggttgaactcatggacctgatacttttctcttgagaagcaaaccagcccaaaagaaaaatggcgtttgttgcaacacagggggccacggtggttgaccagaccactttgatgaaaaagtaccttcagtttgtggcagctctcacagatgtgaatacacctgatgaaacaaagttgaaaatgatgcaagaagttagtgaaaattttgagaatgtcacgtcatctcctcagtattctacattcctagaacatatcatccctcgattccttacatttctccaagatggagaagttcagtttcttcaggagaaaccagcacagcaactgcggaagctcgtacttgaaataattcatagaataccaaccaacgaacatcttcgtcctcacacaaaaaatgttttgtctgtgatgtttcgctttttagagacggaaaatgaagaaaatgttcttatttgtctaagaataattattgagctacacaaacagttcaggccaccgatcacacaagaaattcatcattttctggattttgtgaaacagatttacaaggagcttccaaaagtagtgaaccgctactttgagaaccctcaagtgatccccgagaacacagtgcctcccccagaaatggttggtatgataacaacgattgctgtgaaagtcaacccggagcgtgaggacagtgagactcgaacacattccatcattccgaggggatcactttctctgaaagtgttggcagaattgcccattattgttgttttaatgtatcagctctacaaactgaacatccacaatgttgttgctgagtttgtgcccttgatcatgaacaccattgccattcaggtgtctgcacaagcgaggcaacataagctttacaacaaggagttgtatgctgacttcattgctgctcagattaaaacattgtcatttttagcttacattatcaggatttaccaggagttggtgactaagtattctcagcagatggtgaaaggaatgctccagttactttcaaattgtccagcagagactgcacacctcagaaaggagcttctgattgctgccaaacacatcctcaccacagagctgagaaaccagttcattccttgcatggacaagctgtttgatgaatccatactaattggctcaggatatactgccagagagactctaaggcccctcgcctacagcacgctggccgacctcgtgcaccatgtccgccagcacctgcccctcagcgacctctccctcgccgtccagctcttcgccaagaacatcgacgatgagtccctgcccagcagcatccagaccatgtcctgcaagctcctgctgaacctggtggactgcatccgttccaagagcgagcaggagagtggcaatgggagagacgtcctgatgcggatgctggaggttttcgttctcaaattccacacaattgctcggtaccagctctctgccatttttaagaagtgtaagcctcagtcagaacttggagccgtggaagcagctctgcctggggtgcccactgcccctgcagctcctggccctgctccctccccagcccctgtccctgccccacctccacccccgcccccacccccacctgccacccctgtgaccccggcccccgtgcctcccttcgagaagcaaggagaaaaggacaaggaagacaagcagacattccaagtcacagactgtcgaagtttggtcaaaaccttggtgtgtggtgtcaagacaatcacgtggggcataacatcatgcaaagcacctggtgctcagttcattcccaacaagcagttacaacccaaagagacacagatttacatcaaacttgtgaaatatgcaatgcaagctttagatatttatcaggtccagatagcaggaaatggacagacatacatccgtgtggccaactgccagactgtgagaatgaaagaggagaaggaggtattggagcatttcgctggtgtgttcacaatgatgaaccccttaacgttcaaagaaatcttccaaactacggtcccttatatggtggagagaatctcaaaaaattatgctcttcagattgttgccaattccttcttggcaaatcctactacctctgctctgtttgctacgattctggtggaatatctccttgatcgcctgccagaaatgggctccaacgtggagctctccaacctgtacctcaagctgttcaagctggtctttggctctgtctccctctttgcagctgaaaatgaacaaatgctgaagcctcacttgcacaagattgtgaacagctctatggagctcgcgcagactgccaaggaaccctacaactacttcttgctgctacgggcgctgtttcgctctattggtggaggtagccacgatctcttgtatcaggagttcttgcctctccttccaaacctcctgcaagggctgaacatgcttcagagtggcctgcacaagcagcacatgaaggacctctttgtggagctgtgtctcaccgtccctgtgcggctgagctcgcttttgccgtacctgcccatgcttatggatcccttggtgtctgcactcaatgggtctcagacattggtcagccaaggcctcaggacgctggagctgtgtgtggacaacctgcagcccgacttcctctacgaccacatccagccggtgcgcgcagagctcatgcaggctctgtggcgcaccttacgcaaccctgctgacagcatctcccacgtggcctaccgtgtgctcggtaagtttggcggcagtaacaggaagatgctgaaggagtcgcagaagctgcactacgttgtgaccgaggttcagggccccagcatcactgtggagttttccgactgcaaagcttctctccagctccccatggagaaggccattgaaactgctctggactgcctgaaaagcgccaacactgagccctactaccggaggcaggcgtgggaagtgatcaaatgcttcctggtggccatgatgagcctggaggacaacaagcacgcactctaccagctcctggcacaccccaactttacagaaaagaccatccccaatgttatcatctcacatcgctacaaagcccaggacactccagcccggaagacttttgagcaggccctgacaggcgccttcatgtctgctgtcattaaggacctgcggcccagcgccctgccctttgtcgccagcttgatccgccactatacgatggtggcagtcgcccagcagtgtggccctttcttgctgccttgctaccaggtgggcagccagcccagcacagccatgtttcacagtgaagaaaatggctcgaaaggaatggatcctttggttctcattgatgcaattgctatttgtatggcatatgaagaaaaggagctttgcaaaatcggggaggtggccctagctgtgatatttgatgttgcaagtatcatcctgggctccaaggagagggcctgccagctgcccctgttttcttacatcgtggagcgcctgtgtgcatgttgttatgaacaggcgtggtatgcaaagctggggggtgtggtgtctattaagtttctcatggagcggctgcctctcacttgggttctccagaaccagcagacattcctgaaagcacttctctttgtcatgatggacttaactggagaggtttccaatggggcagtcgctatggcaaagaccacgctggagcagcttctgatgcggtgcgcaacgcctttaaaagacgaggagagagccgaagagatcgtggccgcccaggaaaagtctttccaccatgtgacacacgacttggttcgagaagtcacctctccaaactccactgtgaggaagcaggccatgcattcgctgcaggtgttggcccaggtcactgggaagagtgtcacggtgatcatggaaccccacaaagaggtcctgcaggatatggtcccccctaagaagcacctgctccgacaccagcctgccaacgcacagattggcctgatggaggggaacacgttctgtaccacgttgcagcccaggctcttcacaatggaccttaacgtggtggagcataaggtgttctacacagagctgttgaatttgtgtgaggctgaagattcagctttaacaaagctgccctgttataaaagccttccgtcactcgtacctttacgaattgcggcattaaatgcacttgctgcctgcaattaccttcctcagtccagggagaaaatcatcgctgcactcttcaaagccctgaattccaccaatagtgagctccaagaggccggagaagcctgtatgagaaagtttttagaaggtgctaccatagaagtcgatcaaatccacacacatatgcgacctttgctgatgatgctgggagattaccggagcttgacgctgaatgttgtgaatcgcctgacttcggtcacgaggctcttcccaaattccttcaatgataaattttgtgatcagatgatgcaacatctgcgcaagtggatggaagtggtggtgatcacccacaaagggggccagaggagcgacggaaacgaaatgaagatttgctcagcaattataaacctttttcatctgatcccggctgctcctcagacactggtgaagcctttgctagaggttgtcatgaaaacggagcgggcgatgctgatcgaggcggggagtccattccgagagcccctgatcaagttcctgactcgacatccctcgcagacagtggagctgttcatgatggaagccacactgaacgatccccagtggagcagaatgtttatgagttttttaaaacacaaagacgccagacctctgcgggatgtgctggctgccaaccccaacaggttcatcaccctgctgctgccggggggtgcccagacggctgtgcgccccggttcgcccagcaccagcaccatgcgcctggacctccagttccaggccatcaagatcataagcattatagtgaaaaacgatgactcctggctggccagccagcactctctggtgagccagttgcgacgtgtgtgggtgagtgagaacttccaagagaggcaccgcaaggagaacatggcagccaccaactggaaggagcccaagctgctggcctactgcctgctgaactactgcaaaaggaattacggagatatagaattgctgttccagctgctccgagcctttactggtcgttttctctgcaacatgacattcttaaaagagtatatggaggaagagattcccaaaaattacagcatcgctcagaaacgtgccctgttctttcgctttgtagacttcaacgaccccaacttcggagatgaattaaaagctaaagttctgcagcatatcttgaatcctgctttcttgtacagctttgagaagggggaaggagagcagctcttgggacctcccaatccagaaggagataacccagaaagcatcaccagtgtgtttattaccaaggtcctggaccccgagaagcaggcggacatgctggactcgctgcggatctacctgctgcagtacgccacgctgctggtggagcacgccccccaccacatccatgacaacaacaagaaccgcaacagcaagctgcgccgcctcatgaccttcgcctggccctgcctgctctccaaggcctgcgtggacccagcctgcaagtacagcggacacttgctcctggcgcacattatcgccaaattcgccatacacaagaagatcgtcctgcaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcagccggattcagatatggacccaaattccagtggagaaggagtcaattctgtctcatcctccattaagagaggcctgtccgtggattctgcccaggaagtgaaacgctttaggacggccaccggagccatcagtgcagtctttgggaggagccagtcgctacctggagcagactctctcctcgccaagcccattgacaagcagcacacagacactgtggtgaacttccttatccgcgtggcctgtcaggttaatgacaacaccaacacagcggggtcccctggggaggtgctctctcgccggtgtgtgaaccttctgaagactgcgttgcggccagacatgtggcccaagtccgaactcaagctgcagtggttcgacaagctgctgatgactgtggagcagccaaaccaagtgaactatgggaatatctgcacgggcctagaagtgctgagcttcctgctaactgtcctccagtccccagccatcctcagtagcttcaaacctctgcagcgtggaattgccgcctgcatgacatgtggaaacaccaaggtgttgcgagccgtccacagccttctctcgcgcctgatgagcattttcccaacagagccgagtacttccagtgtggcctccaaatatgaagagctggagtgcctctacgcagccgtcggaaaggtcatctatgaagggctcaccaactacgagaaggccaccaatgccaatccctcccagctcttcgggacccttatgatcctcaagtctgcctgcagcaacaaccccagctacatagacaggctgatctccgtctttatgcgctccctgcagaagatggtccgggagcatttaaaccctcaggcagcgtcaggaagcaccgaagccacctcagcaggtacaagcgagctggtgatgctgagtctggagctggtgaagacgcgcctggcagtgatgagcatggagatgcggaagaacttcatccaggccatcctgacatccctcatcgaaaaatcaccagatgccaaaatcctccgggctgtggtcaaaatcgtggaagaatgggtcaagaataactccccaatggcagccaatcagacacctacactccgggagaagtccattttgcttgtgaagatgatgacttacatagaaaaacgctttccggaagaccttgaattaaatgcccagtttttagatcttgttaactatgtctacagggatgagaccctctctggcagcgagctgacggcgaaacttgagcctgcctttctctctgggctgcgctgtgcccagccactcatcagggcaaagtttttcgaggtttttgacaactccatgaaacgtcgtgtctacgagcgcttgctctatgtgacctgttcgcagaactgggaagccatggggaaccacttctggatcaagcagtgcattgagctgcttctggccgtgtgtgagaagagcacccccattggcaccagctgccaaggagccatgctcccgtccatcaccaacgtcatcaacctggccgatagccacgaccgtgccgccttcgccatggtcacacatgtcaagcaggagccccgggagcgggagaacagcgagtccaaagaggaggatgtagagatagacatcgaactagctcctggggatcagaccagcacgcccaaaaccaaagaactttcagaaaaggacattggaaaccagctgcacatgctaaccaacaggcacgacaagtttctggacactctccgagaggtgaagactggagcgctgctcagcgctttcgttcagctgtgccacatttccacgacgctggcagagaagacgtgggtccagcttttccccagattgtggaagatcctctctgacagacagcagcatgcactcgcgggtgagataagtccatttctgtgcagcggcagtcaccaggtgcagcgggactgccagcccagcgcgctgaactgctttgtggaagccatgtcccagtgcgtgccgccaatccccatccgaccctgcgtcctgaagtacctggggaagacacacaacctctggttccggtccacgctgatgttggagcaccaggcttttgaaaagggtctgagtcttcagattaagccgaagcaaacaacggagttttatgagcaggagagcatcaccccgccgcagcaggagatactggattcccttgcggagctttactccctgttacaagaggaagatatgtgggctggtctgtggcagaagcggtgcaagtactcggagacagcgactgcgattgcttacgagcagcacgggttctttgagcaggcacaagaatcctatgaaaaggcaatggataaagccaaaaaagaacatgagaggagtaacgcctcccctgctattttccctgaataccagctctgggaagaccactggattcgatgctccaaggaattgaaccagtgggaagccctgacggagtacggtcagtccaaaggccacatcaacccctacctcgtcctggagtgcgcctggcgggtgtccaactggactgccatgaaggaggcgctggtgcaggtggaagtgagctgtccgaaggagatggcctggaaggtgaacatgtaccgcggatacctggccatctgccaccccgaggagcagcagctcagcttcatcgagcgcctggtggagatggccagcagcctggccatccgcgagtggcggcggctgccccacgtagtgtcccacgtgcacacgcctctcctacaggcagcccagcaaatcatcgaactccaggaagctgcacaaatcaacgcaggcttacagccaaccaacctgggaaggaacaacagcctgcacgacatgaagacggtggtgaagacctggaggaaccgactgcccatcgtgtctgacgacttgtcccactggagcagcatcttcatgtggaggcagcatcattaccaggcgattgtaactgcctatgagaatagctctcagcatgatcccagttcaaataacgctatgcttggggttcatgcatcagcttcagcgatcatccagtatggaaaaatcgcccggaaacaaggactggtcaatgtagctctggatatattaagtcggattcatactattccaactgttcctatcgtggattgcttccagaagattcgacagcaagttaaatgctacctccagctggcaggcgtcatgggcaaaaacgagtgcatgcagggccttgaagttattgaatctacaaatttaaaatacttcacaaaagagatgacagccgaattttatgcactgaagggaatgttcttggctcagatcaacaagtccgaggaggcaaacaaagccttctctgcagctgtgcagatgcacgatgtgctggtgaaagcctgggccatgtggggcgactacctggagaacatctttgtgaaggagcggcagctgcacctgggcgtgtctgccatcacctgctacctgcacgcctgccggcatcagaacgagagcaaatcgaggaaatacttagccaaggtgctgtggcttttgagttttgatgatgacaaaaacactttggcagatgccgtcgacaagtactgcattggtgtgccacccatccagtggctggcctggatcccacagctgctcacctgcctggttggctcggagggaaagctgctcttgaacctcattagccaggttggacgcgtgtatccccaagcggtctactttcccatccggaccctgtacctgaccctgaaaatagaacagcgggaacgctacaagagcgattctggacagcagcagccaagttcagtgggtaaccagtcccattctgcatcagatccagggcccataagagcaacagcacccatgtggcgctgcagccgaatcatgcacatgcagcgagagctccaccccacccttctgtcttccctggaaggcatcgtcgatcagatggtctggttcagagaaaattggcatgaagaggttctcaggcagctccaacagggcctggcgaaatgttactccgtggcgtttgagaaaagtggagcggtgtccgatgctaaaatcaccccccacactctcaattttgtgaagaagttggtgagcacgtttggggtgggcctggagaatgtgtccaacgtctcgaccatgttctccagcgcagcctctgagtctctggcccggcgggcgcaggccactgcacaagaccctgtctttcagaagctgaaaggccagttcacgacggattttgacttcagcgttccaggatccatgaagcttcataatcttatttctaagttgaaaaagtggatcaaaatcttggaggccaagaccaagcaactccccaaattcttcctcatagaggaaaagtgccggttcttgagcaatttctcggcacagacagctgaagtggaaattcctggggagtttctgatgccaaagccaacgcattattacatcaagattgcacggttcatgccccgggtagagattgtgcagaagcacaacaccgcagcccggcggctgtacatccggggacacaatggcaagatctacccatacctcgtcatgaacgacgcctgcctcacagagtcacggcgagaggagcgtgtgttgcagctgctgcgtctgctgaacccctgtttggagaagagaaaggagaccaccaagaggcacttgtttttcacagtgccccgggttgtggcagtttccccacagatgcgcctcgtggaggacaacccctcttcactttcccttgtggagatctacaagcagcgctgcgccaagaagggcatcgagcatgacaaccccatctcccgttactatgaccggctggctacggtgcaggcgcggggaacccaagccagccaccaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtggatggcattctgaaaacggttctccgggacgagatcattgcttggcacaaaaaaacacaagaggacacgtcctctcctctctcggccgccgggcagccagagaacatggacagccagcaactggtgtccctggttcagaaagccgtcaccgccatcatgacccgcctgcacaacctcgcccagttcgaaggcggggaaagcaaggtgaacaccctggtggccgcggcaaacagcctggacaatctgtgccgcatggaccccgcctggcacccctggctgtgactgtggccgccacggccacccggaatgtgaagggcgctccgggctctgagcccgcagcttttacgacttctccctgcctcgttccttatattcacagaagccccatagtttcactgggttgcggttattttcctggtagtttgcgtgtaagaaagggagaatatagttttagaggaagctgaactatgacgatgctgggcgaagcggttggaaatggcagagctgaaacttattccaagctttcaaaataatcttttaagaagccaggattctccggtctggaatttctgagtgagtcctttttttatggtgtcctccctctgtgaatgtacaggcggaactgtacgaacagctcccttccatccatttttaactctttcggaaataacacctcacagcagcttcgtgcttttgtacagacctttgtaacaagtgtacagaaaactcattttgtttgagaaacaggagttgatgaacccatcatgctggtttttctctgagcacaaagttttaggctgtacacagccagccttgggaatctcgttgagcgttcggcgtggatccacggggccaggccaccctgcgggagcgccacacgcatccacttcggattcagtgggtgaagacagaactctgagagtctgcaggcggctcctgtgctttttatttctggctcttcggatgtcttctagacatttactatcactgcacctgaagaaaaaatcacttttaccttcctaatttaaaaagacaaaacagaaatgtacgttccttcgctagctttagtctttctgttcccatttttataaatctgagcattgataatgttctatctaaatttgtacagtgtgatttttttttttagaataaatattttataaaagggtt

SEQ ID NO: 192527 - DNA, 1845 bp, Homo sapiens
  Payload ID: 18013
  Gene Name: transformer 2 alpha homolog (Drosophila)
  Uniprot ID: Q13595
  ENST ID: ENST00000297071
  CDS Start-End: 218-1066
gcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttgaaaa

SEQ ID NO: 192528 - DNA, 2229 bp, Homo sapiens
  Payload ID: 18013
  Gene Name: transformer 2 alpha homolog (Drosophila)
  Uniprot ID: Q13595
  ENST ID: ENST00000392502
  CDS Start-End: 912-1454
gcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagatgagcggccgcgtctctgttggaaccggcggcgttgcgtctaaaaaggcgaaagccttgaggttgaaggtgggacgagcctaatgaagtggttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttg

SEQ ID NO: 192529 - DNA, 582 bp, Homo sapiens
  Payload ID: 18013
  Gene Name: transformer 2 alpha homolog (Drosophila)
  ENST ID: ENST00000448549
  CDS Start-End: 200-391
gtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagttaatgttcgtgaagaaattgaagagttttttccaagaatgtggaagataaatcaagataaaagaaggctaatgaaaagagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaa

SEQ ID NO: 192530 - DNA, 2142 bp, Homo sapiens
  Payload ID: 18013
  Gene Name: transformer 2 alpha homolog (Drosophila)
  Uniprot ID: Q13595
  ENST ID: ENST00000538367
  CDS Start-End: 822-1367
gcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagagttaatgttcgtgaagaaattgaagagttttttccaagaatgtggaagataaatcaagataaaagaaggctaatgaaaagtattaaagatcagaaaattaaaattgaatgggggaaaaaattgaacagaagattggtcagatagaagcacttgaatatttttttaaggctattttgaattgtttgaattggggaagaatacacgaagtatgaaaaatgaaaaactcaatgaagaatgaagagaagtagaaagcaagagtgaagtagaattaaaagaatctggaagaatgaatgggtcctaggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttg

SEQ ID NO: 192531 - DNA, 1931 bp, Homo sapiens
  Payload ID: 18013
  Gene Name: transformer 2 alpha homolog (Drosophila)
  Uniprot ID: Q13595
  ENST ID: ENST00000621813
  CDS Start-End: 611-1156
gcccgccccctttacgtcgtgctctgaggaggccaggagatttctggcggcgccggcgccattttgctggagcctgcgaccgagtgggagtggagtggagcggctgtggttgccgactctttcctcttccccacggtccagtcagcgggttaattaggccatcggccctcgagccgagacttgtctcttatttagttctggggagcgcctcgtcgacatgagtgatgtggaggaaaacaacttcgagggcagatgagcggccgcgtctctgttggaaccggcggcgttgcgtctaaaaaggcgaaagccttgaggttgaaggtgggacgagcctaatgaagtggagtctcgctctcagtcaaaatctccaacgggaactcctgctcgtgtaaaatcggagagcaggtcaggatctcgtagtccatcaagggtttccaaacactctgaatcccattctcgatcaagatcaaaatccaggtcgaggtcaaggagacattctcatagacgttacactcgatccagatcccactctcactctcataggagacgatctcgaagtagatcatatacaccagaataccggcggcgaaggagccgaagccattctccaatgtctaaccggagaagacatactggcagcagggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggctatggaaagggcaaatggaatggagctggatggtagaagaattcgggtggattattctataaccaagagagcgcacacaccaacaccaggcatctacatgggcagaccaactcatagtggtgggggtggtggaggaggcggcggcggtggaggtggaggtggtggcagacgtcgagattcttactatgatagaggatatgatcgtgggtatgacagatatgaagactatgattaccgatacagaagacgatcaccttctccttattatagtcgatatagatcacgatcaagatctcgttcctacagcccaagacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttg

SEQ ID NO: 192532 - DNA, 943 bp, Homo sapiens
  Payload ID: 18014
  Gene Name: transformer 2 beta homolog (Drosophila)
  ENST ID: ENST00000259043
  CDS Start-End: 1-383
gtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaa

SEQ ID NO: 192533 - DNA, 288 bp, Homo sapiens
  Payload ID: 18014
  Gene Name: transformer 2 beta homolog (Drosophila)
  Uniprot ID: P62995
  ENST ID: ENST00000342294
  CDS Start-End: 154-270
gagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaa

SEQ ID NO: 192534 - DNA, 976 bp, Homo sapiens
  Payload ID: 18014
  Gene Name: transformer 2 beta homolog (Drosophila)
  Uniprot ID: P62995
  ENST ID: ENST00000382191
  CDS Start-End: 410-976
agagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaa

SEQ ID NO: 192535 - DNA, 710 bp, Homo sapiens
  Payload ID: 18014
  Gene Name: transformer 2 beta homolog (Drosophila)
  ENST ID: ENST00000414862
  CDS Start-End: 1-323
gaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttataggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgattttta

SEQ ID NO: 192536 - DNA, 1697 bp, Homo sapiens
  Payload ID: 18014
  Gene Name: transformer 2 beta homolog (Drosophila)
  Uniprot ID: P62995
  ENST ID: ENST00000456380
  CDS Start-End: 170-286
acatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggttaatgttgaagaaggaaaatgcggaagtcgtcatttgacaagttttataaatgagtatttgaagctcaggaataagtgaagctgaaatttgaaaaaataaaagaaagaatgcatgctaattatcagaccagaagtcccacttgtagaatattgagcaatttgtgtgaagtggggaagatgaaagaagtcagaatttgaaacggaagaatgaagaaaagaaataaaaatgaagttaagataagaagtaatctggaatcagaaagcactacgctaagaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttt

SEQ ID NO: 192537 - DNA, 2952 bp, Homo sapiens
  Payload ID: 18014
  Gene Name: transformer 2 beta homolog (Drosophila)
  Uniprot ID: P62995
  ENST ID: ENST00000453386
  CDS Start-End: 277-1143
gtgcgggacgcgctgcagctggagaggaaaggcagagcgaggaggggcgaggccaagaaagcgcgcgtttctgggaggggaggagcctggctaaggagcgccgcgtcacatccggtagagttagagcccgtgcggaggcggtgcggagcatttcggctctgagcggctgggcgaccggcgcgtcgtgcggggctgcggcggagcctccttaaggaaggtgcaagaggttggcagcttcgattgaagcacatcgaccggcgacagcagccaggagtcatgagcgacagcggcgagcagaactacggcgagcgggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtctagatccagaagaagctcccgaaggcattatacccggtcacggtctcgctcccgctcccatagacgatcacgtagcaggtcttacagtcgagattatcgtagacggcacagccacagccattctcccatgtctactcgcaggcgtcatgttgggaatcgggcaaatcctgatcctaactgttgtcttggagtatttgggctgagcttgtacaccacagaaagagatctaagagaagtgttctctaaatatggtcccattgccgatgtgtctattgtatatgaccagcagtctaggcgttcaagaggatttgcctttgtatattttgaaaatgtagatgatgccaaggaagctaaagaacgtgccaatggaatggagcttgatgggcgtaggatcagagttgatttctctataacaaaaagaccacatacgccaacaccaggaatttacatggggagacctacctatggcagctctcgccgtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagactatatgaaaaaaccgggtgcttcaaagtacatgataagggaacactatacctgtcatggatgaactgaagactttgcctgttcattttttaaatattattttcaggtcctttgcttaccaaaggaggcccaatttcactcaaatgttttgagaactgtgtttaaataaacgcaaatgaaaagaaaaatgttggtgcagctgttcacaaagaagtgttcttgttctattataattagagttcttctgtagtttaatcgttagggcagtgtgttccttgggctgaggtgtatctttgctattttgggctgggttgagggggggatgaatttctgtattcctggaaaattcagagtgcataactaggtattagagtgatctccatttggggatggagttacagtaaataactagactgcgggtactttaatacatgttcttattattttgcatttaagtaattttcatgaccaattgtagggatgttgctacaggtgggttattttgttgccttgctaacctttatcgcatctaggtattagtatgtttcaggtactttgggaagaactttacatataatctttagcaatgaaatgatgtagagtaacttaccttagttcaaatagctgtttaagtggcaatgccacgatctgaattgaacctaggtgatcttagtccacagttctcttgatcatgatgtctcaaatctgggtacctgggtgatggaaaataccagtaatggagcataggcagtattggcaggtcttaatttgtaaaacttactgtccagggtgttttcagtgtttgccaacttgtggtaaattaatatgcttagagaactacccttaggtttgtttctgataagcatgtggaaacaacttagtatatgcctgatgggttatttcaaattgttctcaatgagttttgaaacaagaatttgtagtatttatatataaagttgagttttagggtgtggtcccagagggggttgtgttatggatggatacattaaaggctgagaaacctgg

SEQ ID NO: 192538 - DNA, 1773 bp, Homo sapiens
  Payload ID: 18015
  Gene Name: transforming growth factor beta 1 induced transcript 1
  Uniprot ID: O43294
  ENST ID: ENST00000361773
  CDS Start-End: 55-1389
ggggccggatccccggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 192539 - DNA, 1803 bp, Homo sapiens
  Payload ID: 18015
  Gene Name: transforming growth factor beta 1 induced transcript 1
  Uniprot ID: O43294
  ENST ID: ENST00000394858
  CDS Start-End: 85-1419
ggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 192540 - DNA, 1898 bp, Homo sapiens
  Payload ID: 18015
  Gene Name: transforming growth factor beta 1 induced transcript 1
  Uniprot ID: O43294
  ENST ID: ENST00000394863
  CDS Start-End: 131-1516
atctcagcgggtcccggcttccttacatggtcacggccgggcttccagctcccggacgtcccccgccccccgcccccaccggacacggcccccgccctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 192541 - DNA, 1616 bp, Homo sapiens
  Payload ID: 18015
  Gene Name: transforming growth factor beta 1 induced transcript 1
  ENST ID: ENST00000564804
  CDS Start-End: 40-384
gatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcacc

SEQ ID NO: 192542 - DNA, 684 bp, Homo sapiens
  Payload ID: 18015
  Gene Name: transforming growth factor beta 1 induced transcript 1
  ENST ID: ENST00000565360
  CDS Start-End: 35-684
gccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagt

SEQ ID NO: 192543 - DNA, 1453 bp, Homo sapiens
  Payload ID: 18015
  Gene Name: transforming growth factor beta 1 induced transcript 1
  ENST ID: ENST00000567066
  CDS Start-End: 160-318
gttcccccgttcatcgcccccccatccccatctcagcgggtcccggcttccttacatggtcacggccgggcttccagctcccggacgtcccccgccccccgcccccaccggacacggcccccgccctgttcgccccgcgccaccggcccgcgccccgccatggaggacctggacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcc

SEQ ID NO: 192544 - DNA, 668 bp, Homo sapiens
  Payload ID: 18015
  Gene Name: transforming growth factor beta 1 induced transcript 1
  ENST ID: ENST00000562566
  CDS Start-End: 400-668
agcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacat

SEQ ID NO: 192545 - DNA, 573 bp, Homo sapiens
  Payload ID: 18015
  Gene Name: transforming growth factor beta 1 induced transcript 1
  ENST ID: ENST00000565454
  CDS Start-End: 78-573
actgtgtctgtccccgtccctcagatttctttgtgtctgatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccac

SEQ ID NO: 192546 - DNA, 1770 bp, Homo sapiens
  Payload ID: 18015
  Gene Name: transforming growth factor beta 1 induced transcript 1
  Uniprot ID: O43294
  ENST ID: ENST00000567607
  CDS Start-End: 54-1388
ggcctcttcctgcagatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctc

SEQ ID NO: 192547 - DNA, 1302 bp, Homo sapiens
  Payload ID: 18015
  Gene Name: transforming growth factor beta 1 induced transcript 1
  ENST ID: ENST00000563712
  CDS Start-End: 36-221
cctgttcgccccgcgccaccggcccgcgccccgccatggaggacctggatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcc

SEQ ID NO: 192548 - DNA, 4468 bp, Homo sapiens
  Payload ID: 18016
  Gene Name: transforming growth factor beta regulator 1
  ENST ID: ENST00000284290
  CDS Start-End: 210-692
agacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaacactctaaatctatattctattatttacataagaaaattattttggtaaagtaagtaagtcaaaaacacagattacaaaataatatgtactgtataaaattatataactcaagtcaagtgaatggttcagcaaaatagtgtttctctgaatgatgaatttgggggtgatttttacttgcttatactttagtgtccaaattttctacagtgactataaatttcattttaaaactaaaaagttcttacatttggggaaatgcagtgaattcccacatcatgttttaaattactcagccactaaaaatgaatgtgcatggcgtcattaacataatcattgcctgaaccgtatttttcacactatgtactctaggttcctggaggtgaaaggaatctggacttagagttcttggctacctctggctgcccccgaattagaacagcccatgggggtatgtgtattgggagtggaggagtggacgggtagattgactttttctcaggcatcaatctgttacaaggttcatggtttctatggggccagatgcatgagaggtcaaagcatgggcaataggggttaactgaacgagttgaatgctaggaagtcctcaggggagccaacgttccttgtaaagtgtgtagattttttgttttttaactaaataaaatcttggcactgacaaagtta

SEQ ID NO: 192549 - DNA, 4004 bp, Homo sapiens
  Payload ID: 18016
  Gene Name: transforming growth factor beta regulator 1
  Uniprot ID: Q3YBR2
  ENST ID: ENST00000441174
  CDS Start-End: 205-1440
cggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagttctgaagaaaacatgcaagaaaaagaaaatggcgggaggtgctcgcaagctggttcagcccattgccctggatccctcaggacggcctgtgttccccatcggactagggggtctaacagtatatagcctgggggagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagggacaaaaggacccagaagtagaagaatggggatggagtggtgagaattgaatggttaatgcactgccattcataattgccaattgaggacaacacaaatgggattggtactttatagtaataaatctgaccagcagagggagggatcaggcagcagtgtttagagcacaccacactggccactgtaaactgagaagctaagttaactggtattttatgattttgagtatagtctttttataagttgtatacactttacaatgtaaaagaaacaaactttgtataatagcaaatcgggaaggggactgcttaaaatgttaatgcagtgtttttctttttttctctgcataaatggcttgagcatactggcatttacacagaaatgatatatgctgcttttatcatataacaaatattttcccactattacagcctgagtaatacccgtattaaaagagcctcattttagaaagacatttaaaatttttggaacataccacatgtagaaaggttgaactggtttttcagctataatgcatatacaactatagtgtgtacgtataccacatatacatatacttgtatgaagatatgtgtaaaatgtttttactatggatcatggatttaagaaacttgaaaagctgggcacggtggctcacgcctgtaatcccagcactttgggaggctgaggcgggtggatcaagaggtcaggagatcgagaccatcctggctaagtcggtctctaataaaaatacaaaaaattagccaggcgtggtggcacgcgcctgtagtcccagctactcgggaggctgaggcaggaagaatcgcttgaacccgggaggcagaggttgcagtgagccgagaccgcgccactgcactccagcctgggcaacagagcaaaactccaactcaaaaacaaaaacaaaaacaccttgaaaaacactgccttagtatacttaaactatcttttcatctatcagattgttaaggattttttttaaatttgacaacatccagtgtcaatgagggtgagggcaaaaaaaggactaccttggtgagaatgtaagttgtttaatcctttgggagggttaagctgtagatatctaaattttaaatatatatttatcctcttccatgttaagaaccctaagaaataactggacgagtgtggtatgatgtttgcatgtgatattcattacagtattattttaatagtagaaaattgttaaaaatctatatgtccattaataggaaattggttaaataaaatgaggcttccacaaactgaaacactctaaatctatattctattatttacataagaaaattattttggtaaagtaagtaagtcaaaaacacagattacaaaataatatgta

SEQ ID NO: 192550 - DNA, 552 bp, Homo sapiens
  Payload ID: 18016
  Gene Name: transforming growth factor beta regulator 1
  ENST ID: ENST00000531667
  CDS Start-End: 215-552
aagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgt

SEQ ID NO: 192551 - DNA, 1571 bp, Homo sapiens
  Payload ID: 18016
  Gene Name: transforming growth factor beta regulator 1
  ENST ID: ENST00000530731
  CDS Start-End: 224-706
cttacttccaagacagacacggaagtgctgggaggcgccgggagcccgttcggttgcgggtgtctctggccctgcggtcagccctgggaacgtcccggagagctagattcctagaggcccgattccgctagcccggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaaggtacttgctaaagaagctcctccagcttcaggctctaactgaaggggaagtacaggctgcagctccttcccacagttccagtttgcccctgacttatggtgtggccagctctgtgggaactatacagggagctgggcctatttcagggcccagcactggggctgaggaaccatttgggaagaaaactaagaaggagaaaaaagaaaaaggcaaagagaacaacaaactggaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaaataactctcaagggtgatttcccttgattctgcagttaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttca

SEQ ID NO: 192552 - DNA, 2142 bp, Homo sapiens
  Payload ID: 18016
  Gene Name: transforming growth factor beta regulator 1
  ENST ID: ENST00000529543
  CDS Start-End: 91-396
cggaacagacaaagccagcgctcccgcccgctccccgacttaggatccgatgccggcagcgtcctggggcccccgtagcggggctggaccatgagcctgctggacggcctcgcttcctcgccgcgggctccgctgcagtccagcaaggccaggatgaaaaagctcccgaagaagagccagaatgagaagtaccggctgaagtacctgcggctgcgcaaagcggccaaggccacggtgtttgaaaatgctgctatttgtgatgaaattgctcgtcttgaggaaaaatttcttaaagcaaaagaagaaagaagatcatcaccgaccgacctggctttcatgatgagagtgccatctaccccgtgggctattgcagtactcgaatatatgccagcatgaagtgcccagaccagaagtgtctatatacctgtcagatcaaggatggtggtgtgcagcctcagtttgaaattgttcctgaagatgacccccagaatgccattgtcagctcttctgcagatgcttgtcatgcagaactgctcaggactataagcactactatggggaaactaatgcctaacctgcttccagctggagctgacttttttggattttctcatccagccatccacaacctgatccagagctgtccaggagctcgaaaatgcatcaattaccagtgggtgaaatttgatgtgtgcaaacctggagatgggcagctacctgaggggctgccggagaatgatgcagctatgagctttgaagcctttcagagacagatctttgatgaagatcagaatgatccccttctgccaggatccttggacctcccagagcttcagcctgcagcctttgtgtcttcttaccagcccatgtacctgacacatgaacccttggtagatactcacctgcagcacttgaagtctccatcacagggtagcccaattcagtcttcagattgaacaagaagggatcagatgccacatcgtttttgtcgtgattaatttaacttaaactaaaattttgggtatatgaaagaaggcagcaattcagaagtaaagaagatactaacgtatttcatcatggaaggtcctgtggtgatggttttccctgggaaaaccttcagctgctttatttttagtaataaatttctcttgtcaattctgtttactttcatcttgtaatcgggatgtaatcttttttgcttagctctgcctgaggtaaagtaaacttcagcctcttataaacaagagtgatagagagctgcaggctgctacaacaaataccatagacaggttggtttataaataacatgaatttatttctcacagttctggatgctgggaagtccaagttcaaggagcgcagattcaatgtctggtgagggcccacttcctagttcttagacagctgtcttcctgcagtgtcctcacgtggtagaagaggaaggcagctctccggggtcccttttataagatcactaagccggttcatgagaggtctgctctcatgacctaatcacctcccaaaggccccacctcccaataccatcacattaggggttaggatttaacatgaattttggggacatataaacattaagtctgtagtagcagcagctgactaacgagggagatagggagattctgacaaacttctactcttgattgtgatcctaattcaaggaatatcaagtcccagcccctgcaacccaggctgctgcttaattttcatgtcagtatcatcaaaatccaatgttctgcttaaactcaagatggaaagtccagtccaaggtacactgttcatctttttcttcacattttgcacatccttcaaggggatctttaacctctttaacctttgtattgcacctcagataatgtgctttttagctcagtacactgaaaccatatgataacacaaattcacatataattgggggttagtcccatactctataacagacttagtcctgtcttttcattagccatgtaataatataactccatgttccatgcaactggatttttggaccctgttaatagcattaaggtagaggtttactctatcacctaacacctcaacactacctgtgggatgccttagttacccagcagcaggttaccaagggctgtctggaaagggagg

SEQ ID NO: 192553 - DNA, 2243 bp, Homo sapiens
  Payload ID: 18017
  Gene Name: transforming growth factor beta regulator 4
  Uniprot ID: Q969Z0
  ENST ID: ENST00000258770
  CDS Start-End: 123-2018
agcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtca

SEQ ID NO: 192554 - DNA, 1917 bp, Homo sapiens
  Payload ID: 18017
  Gene Name: transforming growth factor beta regulator 4
  Uniprot ID: Q969Z0
  ENST ID: ENST00000361278
  CDS Start-End: 127-1692
gggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtca

SEQ ID NO: 192555 - DNA, 2225 bp, Homo sapiens
  Payload ID: 18017
  Gene Name: transforming growth factor beta regulator 4
  Uniprot ID: Q969Z0
  ENST ID: ENST00000395655
  CDS Start-End: 435-2000
acgtcgcctatcccactccaccagcccagtcttccaccgccctaggaactctcctacgcctacgcaagcagggagggatagggtgacagcaccgacaacaaagggtcgtctcccgcactccgtatgaggatggcgtactggtcggggggcaaccgaagcctttcttcctaggttctttatcttttctaagtttcccatgacctatcgctccgcttgagccctcagcaaagatgtcacccgccgaaaggtgtggccggaagctggaggcgtggcttccggacgtgcggggcgaggctcgtctcgtttccgccggcgctccgagtgacgtagggaagcgcgccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtca

SEQ ID NO: 192556 - DNA, 548 bp, Homo sapiens
  Payload ID: 18017
  Gene Name: transforming growth factor beta regulator 4
  ENST ID: ENST00000495078
  CDS Start-End: 239-548
atggttccggggacagttagggcggcggatggaggtcagcggtggtgctcgctgctggagttagactaagctttttacagctgctttaatcccctcatataaaaagaaaatgtgctggccatataccaagttccaggaagtggagaaagatcaaacgtacattctgctttggcagaaatgaggcctagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtac

SEQ ID NO: 192557 - DNA, 579 bp, Homo sapiens
  Payload ID: 18017
  Gene Name: transforming growth factor beta regulator 4
  ENST ID: ENST00000475893
  CDS Start-End: 196-579
cagtcttccaccgccctaggaactctcctacgcctacgcaagcagggagggatagggtgacagcaccgacaacaaagggtcgtctcccgcactccgtatgaggatggcgtactggtcggggggcaaccgaagcctttcttcctagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcat

SEQ ID NO: 192558 - DNA, 856 bp, Homo sapiens
  Payload ID: 18017
  Gene Name: transforming growth factor beta regulator 4
  ENST ID: ENST00000461363
  CDS Start-End: 112-856
tagggcggcggatggaggtcagcggtggtgctcgctgcggtttggaatcacttgctaggagtcttgtctctctgccacccaggacatcatggcagctcacctggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatg

SEQ ID NO: 192559 - DNA, 530 bp, Homo sapiens
  Payload ID: 18017
  Gene Name: transforming growth factor beta regulator 4
  ENST ID: ENST00000482285
  CDS Start-End: 177-530
tgctcgttccgtgctggcttgccagtgcgcacgcttcctctctagcccgcgcggccaggcctggaagacgccgcccctgttgaccgtccatgaccccagcgagccagttttcgtgacttagtgcaaggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaa

SEQ ID NO: 192560 - DNA, 822 bp, Homo sapiens
  Payload ID: 18017
  Gene Name: transforming growth factor beta regulator 4
  ENST ID: ENST00000483615
  CDS Start-End: 1-822
ccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctaggtgagccccctgcccctagtactactggaactgggaaactgcctggtcttgtctgcctagtgccagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagag

SEQ ID NO: 192561 - DNA, 945 bp, Homo sapiens
  Payload ID: 18017
  Gene Name: transforming growth factor beta regulator 4
  ENST ID: ENST00000478532
  CDS Start-End: 96-945
ccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatgattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccg

SEQ ID NO: 192562 - DNA, 2190 bp, Homo sapiens
  Payload ID: 18017
  Gene Name: transforming growth factor beta regulator 4
  Uniprot ID: Q969Z0
  ENST ID: ENST00000494076
  CDS Start-End: 71-1966
gcgcacctcatggttccggggacagttagggcggcggatggaggtcagcggtggtgctcgctgcgacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtc

SEQ ID NO: 192563 - DNA, 4310 bp, Homo sapiens
  Payload ID: 18018
  Gene Name: transforming growth factor, alpha
  Uniprot ID: P01135
  ENST ID: ENST00000295400
  CDS Start-End: 249-731
gtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaa

SEQ ID NO: 192564 - DNA, 568 bp, Homo sapiens
  Payload ID: 18018
  Gene Name: transforming growth factor, alpha
  ENST ID: ENST00000394241
  CDS Start-End: 207-568
agccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgataca

SEQ ID NO: 192565 - DNA, 812 bp, Homo sapiens
  Payload ID: 18018
  Gene Name: transforming growth factor, alpha
  Uniprot ID: P01135
  ENST ID: ENST00000445399
  CDS Start-End: 6-491
gtaaaatggtcccctcggctggacagctcgccctgttcgctctgggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagctaccttgggctaatctattgagctaatgaaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagct

SEQ ID NO: 192566 - DNA, 1225 bp, Homo sapiens
  Payload ID: 18018
  Gene Name: transforming growth factor, alpha
  Uniprot ID: P01135
  ENST ID: ENST00000418333
  CDS Start-End: 60-539
actcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttcta

SEQ ID NO: 192567 - DNA, 985 bp, Homo sapiens
  Payload ID: 18018
  Gene Name: transforming growth factor, alpha
  ENST ID: ENST00000444975
  CDS Start-End: 398-898
gcccgcctgggagagtggagagaagcgagtagtctcaatgggttggcgcctgggaggcaaggggagtcattaagaatgacaaagaggggactgtccggtcgagcgccgaggcttccccgggaaagtggctgcctgggccgtgcgtgagaacacctgggaaggggaagcggagtgtgaacgggcttgaactttaatccgccgcagctgtgtgtctgctcagacacatgcctacacctacctgcttacctggctgcctccaagcccggctcagccggcgtcgctggcgtgtagactgggccgcctcggaacgggggccggcgtctaaccctctggccgggtcttgcctgcgcccctttggcaccccctgcccacctctaagccccagcgacgagcagagatgttcaagatcggcagaggcgccctcgatctcttttcagagctcttgagctttgggggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctg

SEQ ID NO: 192568 - DNA, 681 bp, Homo sapiens
  Payload ID: 18018
  Gene Name: transforming growth factor, alpha
  ENST ID: ENST00000419940
  CDS Start-End: 1-395
acccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagct

SEQ ID NO: 192569 - DNA, 950 bp, Homo sapiens
  Payload ID: 18018
  Gene Name: transforming growth factor, alpha
  ENST ID: ENST00000450929
  CDS Start-End: 250-747
aacacctgggaaggggaagcggagtgtgaacgggcttgaactttaatccgccgcagctgtgtgtctgctcagacacatgcctacacctacctgcttacctggctgcctccaagcccggctcagccggcgtcgctggcgtgtagactgggccgcctcggaacgggggccggcgtctaaccctctggccgggtcttgcctgcgcccctttggcaccccctgcccacctctaagccccagcgacgagcagagatgttcaagatcggcagaggcgccctcgatctcttttcagagctcttgagctttgggggtattgtgttggctgcgtgccaggccttggagaacagcacgtccccgctgagtgacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaag

SEQ ID NO: 192570 - DNA, 2769 bp, Homo sapiens
  Payload ID: 18019
  Gene Name: transforming growth factor, beta 1
  Uniprot ID: P01137
  ENST ID: ENST00000221930
  CDS Start-End: 868-2040
ccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgccgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacgaaatctatgacaagttcaagcagagtacacacagcatatatatgttcttcaacacatcagagctccgagaagcggtacctgaacccgtgttgctctcccgggcagagctgcgtctgctgaggctcaagttaaaagtggagcagcacgtggagctgtaccagaaatacagcaacaattcctggcgatacctcagcaaccggctgctggcacccagcgactcgccagagtggttatcttttgatgtcaccggagttgtgcggcagtggttgagccgtggaggggaaattgagggctttcgccttagcgcccactgctcctgtgacagcagggataacacactgcaagtggacatcaacgggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtgcgctcctgcaagtgcagctgaggtcccgccccgccccgccccgccccggcaggcccggccccaccccgccccgcccccgctgccttgcccatgggggctgtatttaaggacacccgtgccccaagcccacctggggccccattaaagatggagagaggactgcggatctctgtgtcattgggcgcctgcctggggtctccatccctgacgttcccccactcccactccctctctctccctctctgcctcctcctgcctgtctgcactattcctttgcccggcatcaaggcacaggggaccagtggggaacactactgtagttagatctatttattgagcaccttgggcactgttgaagtgccttacattaatgaactcattcagtcaccatagcaacactctgagatgcagggactctgataacacccattttaaaggtgaggaaacaagcccagagaggttaagggaggagttcctgcccaccaggaacctgctttagtgggggatagtgaagaagacaataaaagatagtagttcaggccaggcggggtggctcacgcctgtaatcctagcacttttgggaggcagagatgggaggattacttgaatccaggcatttgagaccagcctgggtaacatagtgagaccctatctctacaaaacacttttaaaaaatgtacacctgtggtcccagctactctggaggctaaggtgggaggatcacttgatcctgggaggtcaaggctgcag

SEQ ID NO: 192571 - DNA, 559 bp, Homo sapiens
  Payload ID: 18019
  Gene Name: transforming growth factor, beta 1
  ENST ID: ENST00000598758
  CDS Start-End: 1-362
ggttcactaccggccgccgaggtgacctggccaccattcatggcatgaaccggcctttcctgcttctcatggccaccccgctggagagggcccagcatctgcaaagctcccggcaccgccgagccctggacaccaactattgcttcagctccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaagctcaatgaacagaacctcatccaggaagtccccaacatctggcaacgtgaagttggctaggaggaaggaagtgccccaaagagaacaagaagaagaggaccctgcattgacgttcctctgggaagcactcatttcctacctttcatttctaagaccgcatgatctgggacatccttcccttcctcgtcggttcgctttattgttcggtcttttaggtcctcgtcagtgggacaaattacaatagctttgcgctggaa

SEQ ID NO: 192572 - DNA, 5053 bp, Homo sapiens
  Payload ID: 18020
  Gene Name: transforming growth factor, beta 2
  Uniprot ID: P61812
  ENST ID: ENST00000366929
  CDS Start-End: 468-1796
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 192573 - DNA, 4969 bp, Homo sapiens
  Payload ID: 18020
  Gene Name: transforming growth factor, beta 2
  Uniprot ID: P61812
  ENST ID: ENST00000366930
  CDS Start-End: 468-1712
gcccctcccgtcagttcgccagctgccagccccgggaccttttcatctcttcccttttggccggaggagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaataagtctgtaagtttttttttttctttttaattgtaaatggttctttgtcagtttagtaaaccagtgaaatgttgaaatgttttgacatgtactggtcaaacttcagaccttaaaatattgctgtatagctatgctataggttttttcctttgttttggtatatgtaaccatacctatattattaaaatagatggatatagaagccagcataattgaaaacacatctgcagatctcttttgcaaactattaaatcaaaacattaactactttatgtgtaatgtgtaaatttttaccatattttttatattctgtaataatgtcaactatgatttagattgacttaaatttgggctctttttaatgatcactcacaaatgtatgtttcttttagctggccagtacttttgagtaaagcccctatagtttgacttgcactacaaatgcattttttttttaataacatttgccctacttgtgctttgtgtttctttcattattatgacataagctacctgggtccacttgtcttttcttttttttgtttcacagaaaagatgggttcgagttcagtggtcttcatcttccaagcatcattactaaccaagtcagacgttaacaaatttttatgttaggaaaaggaggaatgttatagatacatagaaaattgaagtaaaatgttttcattttagcaaggatttagggttctaactaaaactcagaatctttattgagttaagaaaagtttctctaccttggtttaatcaatatttttgtaaaatcctattgttattacaaagaggacacttcataggaaacatctttttctttagtcaggtttttaatattcagggggaaattgaaagatatatattttagtcgatttttcaaaaggggaaaaaagtccaggtcagcataagtcattttgtgtatttcactgaagttataaggtttttataaatgttctttgaaggggaaaaggcacaagccaatttttcctatgatcaaaaaattctttctttcctctgagtgagagttatctatatctgaggctaaagtttaccttgctttaataaataatttgccacatcattgcagaagaggtatcctcatgctggggttaatagaatatgtcagtttatcacttgtcgcttatttagctttaaaataaaaattaataggcaaagcaatggaatatttgcagtttcacctaaagagcagcataaggaggcgggaatccaaagtgaagttgtttgatatggtctacttcttttttggaatttcctgaccattaattaaagaattggatttgcaagtttgaaaactggaaaagcaagagatgggatgccataatagtaaacagcccttgtgttggatgtaacccaatcccagatttgagtgtgtgttgattatttttttgtcttccacttttctattatgtgtaaatcacttttatttctgcagacattttcctctcagataggatgacattttgttttgtattattttgtctttcctcatgaatgcactgataatattttaaatgctctattttaagatctcttgaatctgttttttttttttttaatttgggggttctgtaaggtctttatttcccataagtaaatattgccatgggaggggggtggaggtggcaaggaaggggtgaagtgctagtatgcaagtgggcagcaattatttttgtgttaatcagcagtacaatttgatcgttggcatggttaaaaaatggaatataagattagctgttttgtattttgatgaccaattacgctgtattttaacacgatgtatgtctgtttttgtggtgctctagtggtaaataaattatttcgatgatatgtggatgtctttttcctatcagtaccatcatcgagtctagaaaacacctgtgatgcaataagactatctcaagctggaaaagtcataccacctttccgattgccctctgtgctttctcccttaaggacagtcacttcagaagtcatgctttaaagcacaagagtcaggccatatccatcaaggatagaagaaatccctgtgccgtctttttattcccttatttattgctatttggtaattgtttgagatttagtttccatccagcttgactgccgaccagaaaaaatgcagagagatgtttgcaccatgctttggctttctggttctatgttctgccaacgccagggccaaaagaactggtctagacagtatcccctgtagccccataacttggatagttgctgagccagccagatataacaagagccacgtgctttctggggttggttgtttgggatcagctacttgcctgtcagtttcactggtaccactgcaccacaaacaaaaaaacccaccctatttcctccaatttttttggctgctacctacaagaccagactcctcaaacgagttgccaatctcttaataaataggattaataaaaaaagtaattgtgactcaa

SEQ ID NO: 192574 - DNA, 2522 bp, Homo sapiens
  Payload ID: 18021
  Gene Name: transforming growth factor, beta 3
  Uniprot ID: P10600
  ENST ID: ENST00000238682
  CDS Start-End: 299-1537
tgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatat

SEQ ID NO: 192575 - DNA, 1280 bp, Homo sapiens
  Payload ID: 18021
  Gene Name: transforming growth factor, beta 3
  Uniprot ID: P10600
  ENST ID: ENST00000556285
  CDS Start-End: 101-1030
ggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatgctattcacaaacatctccaggaagaagactgaaaatctctcacagagattttctctgtgaaatctctttctgttttcctgggagtcccactgtttttccataggctaactctggaaggagctggctgaagtaaatgaggaaaactctgtg

SEQ ID NO: 192576 - DNA, 5720 bp, Homo sapiens
  Payload ID: 18022
  Gene Name: transforming growth factor, beta receptor 1
  Uniprot ID: P36897
  ENST ID: ENST00000374990
  CDS Start-End: 96-1376
gcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaa

SEQ ID NO: 192577 - DNA, 6516 bp, Homo sapiens
  Payload ID: 18022
  Gene Name: transforming growth factor, beta receptor 1
  Uniprot ID: P36897
  ENST ID: ENST00000374994
  CDS Start-End: 118-1629
aaagggccggagcgaggccgccgcggcggctagggaggtggggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaa

SEQ ID NO: 192578 - DNA, 1678 bp, Homo sapiens
  Payload ID: 18022
  Gene Name: transforming growth factor, beta receptor 1
  ENST ID: ENST00000549766
  CDS Start-End: 57-1208
ggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacag

SEQ ID NO: 192579 - DNA, 526 bp, Homo sapiens
  Payload ID: 18022
  Gene Name: transforming growth factor, beta receptor 1
  ENST ID: ENST00000552573
  CDS Start-End: 148-526
acaaatctggagctcattttggcgtcgcagagggaagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcag

SEQ ID NO: 192580 - DNA, 5933 bp, Homo sapiens
  Payload ID: 18022
  Gene Name: transforming growth factor, beta receptor 1
  Uniprot ID: P36897
  ENST ID: ENST00000552516
  CDS Start-End: 57-1580
ggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtg

SEQ ID NO: 192581 - DNA, 565 bp, Homo sapiens
  Payload ID: 18022
  Gene Name: transforming growth factor, beta receptor 1
  ENST ID: ENST00000546584
  CDS Start-End: 199-565
aatacaggtatctggcctcaaggagtttacagtttcataggagaaagaaaaacaaaactagcaattctgaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcag

SEQ ID NO: 192582 - DNA, 582 bp, Homo sapiens
  Payload ID: 18022
  Gene Name: transforming growth factor, beta receptor 1
  ENST ID: ENST00000548365
  CDS Start-End: 240-582
ttttttgaatgctgctgtgcatgaggcatggtgttagatggcagattgacagaaatgactaatacaggtatctggcctcaaggagtttacagtttcataggagaaagaaaaacaaaactagcaattctgcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagact

SEQ ID NO: 192583 - DNA, 680 bp, Homo sapiens
  Payload ID: 18022
  Gene Name: transforming growth factor, beta receptor 1
  ENST ID: ENST00000549021
  CDS Start-End: 339-680
aattggaatgtttggatttaagaacatgtctgtgctttgcaatttcatgtgaccatggtgaaattatgcacacattctatcattgtgattcaacaagtattttttgaatgctgctgtgcatgaggcatggtgttagatggcagattgacagaaatgactaatacaggtatctggcctcaaggagtttacagtttcataggagaaagaaaaacaaaactagcaattctgcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctg

SEQ ID NO: 192584 - DNA, 533 bp, Homo sapiens
  Payload ID: 18022
  Gene Name: transforming growth factor, beta receptor 1
  ENST ID: ENST00000547314
  CDS Start-End: 180-533
ctgaagaaaggactagtctgacaggaagaattacaaatctggagctcattttggcgtcgcagagggaagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtca

SEQ ID NO: 192585 - DNA, 1538 bp, Homo sapiens
  Payload ID: 18022
  Gene Name: transforming growth factor, beta receptor 1
  ENST ID: ENST00000550253
  CDS Start-End: 198-1502
agattgacagaaatgactaatacaggtatctggcctcaaggagtttacagtttcataggagaaagaaaaacaaaactagcaattctgcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactgtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtacatggcccctgaagttctcgatgattccataaatatgaaacattttgaatccttcaaacgtgctgacatctatgcaatgggcttagtattctgggaaattgctcgacgatgttccattggtggaattcatgaagattaccaactgccttattatgatcttgtaccttctgacccatcagttgaagaaatgagaaaagttgtttgtgaacagaagttaaggccaaatatcccaaacagatggcagagctgtgaagccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttca

SEQ ID NO: 192586 - DNA, 2827 bp, Homo sapiens
  Payload ID: 18023
  Gene Name: transforming growth factor, beta receptor associated protein 1
  Uniprot ID: Q8WUH2
  ENST ID: ENST00000258449
  CDS Start-End: 21-2603
cagcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgtgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaaaatccccaaaacagaaacatacaagagttcacctgtc

SEQ ID NO: 192587 - DNA, 5979 bp, Homo sapiens
  Payload ID: 18023
  Gene Name: transforming growth factor, beta receptor associated protein 1
  Uniprot ID: Q8WUH2
  ENST ID: ENST00000393359
  CDS Start-End: 428-3010
cccgcagcggcgggggcggagaagagacctcagccccgcgggctcgcacagctggcgcggaccacgctctcgcccggggccggcggcctcagcgccccccgaatgaacaccttccgcccgctggccgccccgcgaggcgggccgtgtcgtggccccggtgcacggagggggacgccgaggcccggagcagggcccgtctcggcctgtgctcggagccaggcggcagggcccgcgggccggcgggcggcgcggagacggctgcgctcccgccctccgccagcgcctggcggccgccccacgtgacgggaagcggcggctgcggggtcgggccagcccaggagccgcgggccggagcggggcggcggggccccaggccgcggggcggcgcgggacggcgggcgccggcgccgcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgtgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttgaaaaaaaaaaaaagggagtcttcctcatgcagtccagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcgattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatgga

SEQ ID NO: 192588 - DNA, 5595 bp, Homo sapiens
  Payload ID: 18023
  Gene Name: transforming growth factor, beta receptor associated protein 1
  Uniprot ID: Q8WUH2
  ENST ID: ENST00000595531
  CDS Start-End: 21-2603
cagcagatcagccagtagacatgatgagcatcaaagcctttacgcttgtctctgctgtggagcgggagctgctgatgggcgacaaggagcgcgtcaacatagagtgcgtggagtgctgcggcagggacctctacgtgggcaccaacgactgcttcgtctaccacttcctgttggaggagaggccagtgcctgctgggccagccacgttcactgccaccaaacagctgcagagacacttgggcttcaagaagcccgtgaacgagctgcgtgcggcctcagcactcaacaggctgctggtgctgtgtgacaactccatcagcctggtcaacatgctgaacctcgagccagtgccttcgggggcccgcatcaagggggcagccacgtttgcactgaacgagaaccctgtgagtggggaccccttctgtgtagaagtttgcatcatctctgtcaaacgcagaaccatccagatgtttctggtgtacgaggaccgggtgcagatcgtcaaggaggtgtcgactgccgagcagcccctcgctgtggctgtggacggccacttcctgtgtctggctctgaccactcagtacatcatccacaattacagcacaggcgtctcccaggacctgtttccctactgcagtgaggagaggccgccgatcgtcaagaggatagggagacaggagttcctgctggcgggccccggagggctgggcatgtttgccacagtcgcagggatatcccagcgcgcccccgtgcactggtcggagaatgtgattggggcggctgtgtcctttccatacgtcatagcgctcgatgacgaattcatcacagtccacagcatgttggatcagcaacagaagcagacgctgccctttaaggagggccatatcctacaggactttgaaggaagagtgatcgttgccacaagtaaaggagtttacatcttggttccattacctttggaaaaacaaatacaggatcttctagcaagccgcagagtagaagaggctttggttttagcaaaaggagcccggaggaacattccaaaggaaaaatttcaggtaatgtacagaaggattctgcagcaggcgggatttatacagtttgcacaacttcagttcctggaagctaaagagctcttcagaagcggccagcttgatgtccgggagctgatctctctctaccccttcctgttgcccacctcctcctccttcacccggtcccaccctcctcttcatgagtacgcagacctgaaccagctgacccagggggaccaggagaagatggccaagtgcaaacgcttcctcatgagctacctgaacgaggtccgcagcacagaggtagcaaatggctacaaggaggacatcgacacagccttgctcaaactgtatgcagaggctgaccacgacagcctgctggacctcctggtcactgagaacttctgtcttctgacggacagtgctgcctggctagagaagcacaaaaagtattttgcacttggactgctctatcattataataaccaagatgctgctgcagttcagttgtgggtgaacattgtgaatggcgatgtccaggactccacacgctcagacctgtatgaatacatcgtggattttcttacctactgcttagacgaggaactagtgtgggcctatgctgattgggtcctgcagaaaagtgaagaggtcggagttcaggttttcaccaagagacctttggatgaacagcagaagaacagttttaatccagacgacattatcaattgccttaaaaaataccctaaagcccttgtgaagtatctggaacatcttgtgatagacaagagactgcagaaagaagagtatcacacccacttagctgtgctgtacctggaagaggtgctgctgcagagggcctccgccagtggcaagggtgcagaggccaccgagacgcaggccaagctgcggcggctgctccagaaatctgatttataccgagtccactttcttctcgagaggctgcagggagctggcctgcccatggagagcgccatcctgcacgggaagctgggcgagcatgagaaggcgctgcatatcctggtgcacgagctgcaggactttgcagcggccgaggactactgcctgtggtgctccgagggccgagacccaccccaccgccagcaactctttcacacgctgctggccatctacctgcatgctggccccactgcccacgagctggccgtggctgccgtggacctgctgaaccgccacgccaccgaatttgatgcagcccaggtgctgcagatgctgcctgacacctggtcagtgcagctcctctgcccattcctgatgggggccatgagggacagcatccatgccaggaggaccatgcaggtggctctcggcctggccaggtccgaaaacttaatctacacctacgataagatgaagttgaaaggaagctcaatccaactctcagacaaaaagctttgtcagatatgccaaaatcccttttgtgagcctgtgtttgttagatacccaaatggtggtcttgtgcacacccactgtgccgccagcagacacacaaaccccagctcatccagtcctggcactcggacttgaaaagcttggcccaagggtgcgaggggaactccgagttctttctgagcctgctggacatgaagagcagatgaccaccatgctctgtgtcagccaggacgaagggagacatctgggtgccagggagccttccgtccatacgcaacaaggactcctcgctgctgaccaggctctatgaatgtacatggaatgaccaggctctatgaatgtacatggaaaacccctaaaaatccccaaaacagaaacatacaagagttcacctgtccaggtacatagtaatccaagacagaggtctactttgaaaaaaaaaaaaagggagtcttcctcatgcagtccagacccaggtgggggatcccccaccacccccacactccaacctttagactcatgtttgcactggaaacgtggcttcaccatggctggcgacaaagtcctctcttgcctgggtgagtggcgagggcacagagcctcatgggggtcagccttgccctcctgcagaaacacgttctccatccacgccgctcactcatgggcccatttcccagggttacctcgtgggctctgcctttgccctcagaaacggctgaccctggagaagtacctttgttccttctttcttcctctccggctctcagctcccaaaagattctgccttgtgtacccaagcactcactcttgggtgaactaatgcttctggctgcctagcaagtgaagatctgttgagaaactgagaacgctccaagagagaagctgctctcccctccttgaagaagccgcggacacgggaaacccacggcgggcaagggcccagctgtgtgctcctttcctgtcatggcatctgctgatttgaaactccatgacgaacacgttgaactaaacatttttatttaaatttgtatcatgttcgtagttgctctcttgttgagagagtcatctgtcctgtttgttaggggtattttttcttgttaaaatgtatctcctgttgaatactcgggaaattcaaagggaagtgtggtcagcacacactgagcgttcttttctggagaggccggttttagcctcgtacctttagcaggaccgacagcgggtggaagggcccgtgtgctggatgggggtgtcgcctcctggatggcacaccctcccgaggacatccagacaggctgtgtcaccctccagcactttatgtgcctgctctgaggtgtcctgaacacacagcaacggcctctccttcatcacaggccggggattccttttgtgtttctgtataacatcgatgacgagctgaagctgttgtcacttcactgccctctttggaatttcttcattgtgctgactgattctattaggggctaacaataaaggcagtctacccactactatcatgcttgggaaacaagcgtcagcttgtacatatgacaagagaggaccctgaatacaccctctcttcatcagcccaagccttactgaggtgggatgaagacctcattctctgttctttaaaacatgtttcgtgaactaatattggtccatgtattttttgtccttttgggactctaagtgggtcaagaagcaaaaacatccatgtgttgtttggggggaattggcaccattttttcctgactatgtttcaattaactaaagaataaatgatgaagaaattctccttgtagcacaactgtatgctgtgtaaattggtgtgagctcaaagcccagtcatgtgttttacctgtgggtgactctgttgtagaatggtcatattactgcatatgttatcatgacaacttgtgagtttgagtttatatttctcaaagaacaagttacccgtatatgcaacattgcgccattaaaagcttatttctctgtacacaaaatgggtaaaatcttgaaaaaacttagtaatttctcattcctaacacacagacagagtctcactctgtcacccaggctggagtgcagtggcgcaatctcggctcactgcaacctccacctcctgggttcaagcgattctgctgcctcagcctcccgagtagctgggactacaggtgcatgccaccacgcccagctaatttttgtatttttagtagagacggggtttcaccatgttggccaggatggtctcggtctcctgacctcgtgatctgcctgcctcggcctcccaaagtgctgggattacaggcgtgagccactgcgcccagccaacactagtcatttttattttttcactgaacattgatcaatactctaaaatgtttgtcatcctttagaataatgggaattaaagttgagcagttttccatctctaccaaatccttcaccacaagcagcattctattacagtatgaagaattgtctcatatgttaaaactgtacttttctctaacctttctctcactcctacaaggcccttttctcaaatcatatttctgagagaaatgtatggttctttctcacaggcctgctgatttgtaactgtgccatcgaatagagcaattagatccatcagacctttttcccctcattaggttcagtggaaccattctggttaaaacagcatgaactgaactcagtttacattcatattctatgggcaataccatttggtttttggaactgtttatctgctgttccctatcaagtattaatgtagggatgtcactcaggctgcgttgcactgggctgagttcaactgcgacgctctcactgacgcgtgcttacatgtgcttctcacttccggagcacaggcaggtggctgcggggtcccagctctgaatggatgcccatgatgcaactggggcagcccttgctttttgcttgctctcccacagaaacctttgtccttgcaactttatcctttgtcccgattgggtcccagatacacaaaatgtacaaatgtaaacttgctcattttattaaaattcttttagttctttgttctttctgtaattttttaaaataaaaattgccttgatggagtgatggttttcactcgcaccat

SEQ ID NO: 192589 - DNA, 4621 bp, Homo sapiens
  Payload ID: 18024
  Gene Name: transforming growth factor, beta receptor II (70/80kDa)
  Uniprot ID: P37173
  ENST ID: ENST00000295754
  CDS Start-End: 383-2086
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctag

SEQ ID NO: 192590 - DNA, 4605 bp, Homo sapiens
  Payload ID: 18024
  Gene Name: transforming growth factor, beta receptor II (70/80kDa)
  Uniprot ID: P37173
  ENST ID: ENST00000359013
  CDS Start-End: 284-2062
actcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcggatgtggaaatggaggcccagaaagatgaaatcatctgccccagctgtaataggactgcccatccactgagacatattaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtgggaactgcaagatacatggctccagaagtcctagaatccaggatgaatttggagaatgttgagtccttcaagcagaccgatgtctactccatggctctggtgctctgggaaatgacatctcgctgtaatgcagtgggagaagtaaaagattatgagcctccatttggttccaaggtgcgggagcacccctgtgtcgaaagcatgaaggacaacgtgttgagagatcgagggcgaccagaaattcccagcttctggctcaaccaccagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 192591 - DNA, 6465 bp, Homo sapiens
  Payload ID: 18025
  Gene Name: transforming growth factor, beta receptor III
  Uniprot ID: Q03167
  ENST ID: ENST00000212355
  CDS Start-End: 516-3071
gagagcccccggtggggccggcggaggagcgcccttccccccgcgcgctgattgctgtggcgtcctgcccgtccccgcccgcgtgtgtgcgagggagggcgagtgcgccgggtcggcctgatgggggtaatcgagggtttcggggacgccgagcggcactttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttatt

SEQ ID NO: 192592 - DNA, 4550 bp, Homo sapiens
  Payload ID: 18025
  Gene Name: transforming growth factor, beta receptor III
  Uniprot ID: Q03167
  ENST ID: ENST00000370399
  CDS Start-End: 685-3237
aagaatcttgtttttttgagacggagtctcaccctgtcgcccgggctggagtgcagtggcgcgatcgcaacctccgcttcccgggttcaagggattctcctgcctcagcctcctgagtagctgggactacaggcgcacgccactacacccggccaatttttgtatttatttattttattttattttattttttagtagagacggggtttcaccatgttggccagaacagtctcgatctcctaacctcgtgatccacccgcctcgggctcccaaagtgttgagattacaggcgtgagccaccgcgcccgtccagaattatctttaaaatttatttctttaagatttgtagctactaagaaagaaaggagctttttttccttgggccttcaaactgaaagaaccgcatgagcctgaagctgcgcatggtcttaacatcaggctgtgcaggaagaagctatctgcagatggatgccagcacacacaaggaagcagagctctggcaacattgagtcaaagcaaggacacaacatcagagggacggcagagaatccttgtgtgtagatctttggtggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgtt

SEQ ID NO: 192593 - DNA, 551 bp, Homo sapiens
  Payload ID: 18025
  Gene Name: transforming growth factor, beta receptor III
  ENST ID: ENST00000417833
  CDS Start-End: 446-551
actttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgagctctgcagctctcctccctcctgtaatgcttcctctgcctgcagtgtcattcatcacctgacttttaaaatcttcgcttatcctcaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcct

SEQ ID NO: 192594 - DNA, 2908 bp, Homo sapiens
  Payload ID: 18025
  Gene Name: transforming growth factor, beta receptor III
  Uniprot ID: Q03167
  ENST ID: ENST00000465892
  CDS Start-End: 346-2898
cagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccag

SEQ ID NO: 192595 - DNA, 6455 bp, Homo sapiens
  Payload ID: 18025
  Gene Name: transforming growth factor, beta receptor III
  ENST ID: ENST00000533089
  CDS Start-End: 516-785
ccatctctactaaaaatacaaaaattagccaggcgtagtggcgcatgtctgtaatcccagctacttgggaggctgaggcaggagaatcgcttgaacccaggaggcggaggttgcagtgagccaagactgcgccactgtgctccagcttggcgacagagagagactctatctcaaaaaaaaaaaaaaaaagccaataacaaatatgtcatttgcaaaagtatttgctataaaaatctttattagatagtcactgccctcagtctagtttgcttgagtgctattttgcatcttttaagataaatttcttacattacgcttttcagaaattctctgtttaattttagtgtctgtttgtttatgaagtttcttcattaagttttcttattgaaatttgttttacaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggcctgttcaatgaatcactattaagaacccactgtgtgctagagtccttcagctgaacctgaaatttgtacaactcttggaggatgaggggcaaattacagagtccctgctgacttactgagtgagcctctgctgaaactccagaaattgtgtaagtggaccccttccccacaaaagattcagaaagcagcgcactatacatgggacacatcctagagaaaaggggtgtggtcacacttcacctgaatcccatctcctcagtccacatccaccacaagtctgttgtgttcctgctcaactccccacaccccctggtgtggcatctgaagacagagagacttgccactggggtctccagactgtttttggttacccagggagcctaaaggagctgtggaaagcgaatgggtctcttgactctcagtccacgatgcataagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaa

SEQ ID NO: 192596 - DNA, 3913 bp, Homo sapiens
  Payload ID: 18025
  Gene Name: transforming growth factor, beta receptor III
  ENST ID: ENST00000532540
  CDS Start-End: 169-318
ccgctttcctccaacttgctgcgggtggatctccgctggacacaccgcctccgaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggctggagtgcaatggcgcgatcttggctcactgcaacctccgcctcccgggttcaagcgattcttctgcctcagcctcctgagtactaggattacaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggca

SEQ ID NO: 192597 - DNA, 3927 bp, Homo sapiens
  Payload ID: 18025
  Gene Name: transforming growth factor, beta receptor III
  Uniprot ID: Q03167
  ENST ID: ENST00000525962
  CDS Start-End: 63-2618
gattgtctgtgctctgagcaggctgaagtgactggacgagacgcactgttggagaaataaaaatgacttcccattatgtgattgccatctttgccctgatgagctcctgtttagccactgcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtcacacttcacctgaatcccatctcctcagtccacatccaccacaagtctgttgtgttcctgctcaactccccacaccccctggtgtggcatctgaagacagagagacttgccactggggtctccagactgtttttggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatgcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccattgtgatacaggttccagcccttggggacagtagtggttggccagatggttatgaagatctggagtcaggtgataatggatttccgggagatatggatgaaggagatgcttccctgttcacccgacctgaaatcgtggtgtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaagtgtgtgcctcctgacgaagcctgcacctcgctggacgcctcgataatctgggccatgatgcagaataagaagacgttcactaagccccttgctgtgatccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacacaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctcct

SEQ ID NO: 192598 - DNA, 1260 bp, Homo sapiens
  Payload ID: 18026
  Gene Name: transforming growth factor, beta receptor III-like
  Uniprot ID: H3BV60
  ENST ID: ENST00000565886
  CDS Start-End: 124-1074
agcttcggaggcttctctaggggcgcatggctctgcaaccggctcagttgctgggctgtgcgagtcccaggggtcgccagggggcacatcaccgtcaggggggaaagtggcgcggagcccatcatgggtgaatcggccgccgcaaccgcatcccttttccaaaggcggcggcgggggcgaggtggtcgggtcacttttcccggaggcctaaagggcagcgcgcgttttctctcctttgggccgcccttccccgccccgccagctcccccgttccccgcggcgcccggcccctggctgcgcagacccctcttcagcctgaagctgtccgacacagaggacgtctttcctcgccgcgcggggccgctcgaggtcccggccgacagccgcgtgttcgtgcaggcggccttggcccgtccctccccgcgctggggcctggccctgcaccgctgctcagtgacgccgtcctcacgcccggccccggggcccgccctggctctgctgcgtgagggctgccccgccgacacctctgtcgccttcccgccaccgccgccgccgagcccgggtgccgcccgccccgcgcgtttcagcttccgcctgcgcccggtcttcaacgcctcggtgcagttcctgcactgccagctgagccgctgccgccgcctccggggagtccgccgggcgcctgcgcctctgacgccgccgccgccgccgccgccatcgcggtgtctgcctcaggacgaggcgtgcgccgacactggcagtggcagcgccgagggcctggctgctgacggcccccacctgcacacgctgacgcagcctatcgtggtcaccgtgccgcggccgccccccaggccgcccaagagtgtccccggccgtgcagtgcgccctgagcctcccgcgccggcccccgcggccctggaacccgcgccggtggtggcgctggtgttggcagccttcgtgctgggcgccgcgctggccgccgggctgggtctcgtctgtgcgcactcagcgccccacgcccctggcccgcccgcgagagcctcgcccagcggtccccagcccaggaggtcccagtgaggaagggatggtgcgcccccaacatggtccggagatacacccagctaccaattcgggaccaggaccaacaggaccggacccgcctccctggacctcggacctgatgaggccacgacccctgcgcttctctcctccccctgtccctcccacctgtgctcaaaataaacctctggactgaccggctaa

SEQ ID NO: 192599 - DNA, 2804 bp, Homo sapiens
  Payload ID: 18027
  Gene Name: transforming growth factor, beta-induced, 68kDa
  Uniprot ID: Q15582
  ENST ID: ENST00000442011
  CDS Start-End: 162-2213
ctccttgcacgggccggcccagcttccccgcccctggcgtccgctccctcccgctcgcagcttacttaacctggcccgggcggcggaggcgctctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacat

SEQ ID NO: 192600 - DNA, 1691 bp, Homo sapiens
  Payload ID: 18027
  Gene Name: transforming growth factor, beta-induced, 68kDa
  ENST ID: ENST00000514554
  CDS Start-End: 1-1099
ggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 192601 - DNA, 2469 bp, Homo sapiens
  Payload ID: 18027
  Gene Name: transforming growth factor, beta-induced, 68kDa
  ENST ID: ENST00000507018
  CDS Start-End: 1-385
gccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgtgagatgacctccgtctgcccgggggactcttatggggaactgccttacttccccgaggggaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttg

SEQ ID NO: 192602 - DNA, 582 bp, Homo sapiens
  Payload ID: 18027
  Gene Name: transforming growth factor, beta-induced, 68kDa
  ENST ID: ENST00000508767
  CDS Start-End: 1-582
caacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctgga

SEQ ID NO: 192603 - DNA, 1034 bp, Homo sapiens
  Payload ID: 18027
  Gene Name: transforming growth factor, beta-induced, 68kDa
  ENST ID: ENST00000508076
  CDS Start-End: 248-445
gccaactgactgctggggcagatttgtggtcatgaacatgtgctttgtgtcctctgaccattagacagattgagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaac

SEQ ID NO: 192604 - DNA, 731 bp, Homo sapiens
  Payload ID: 18027
  Gene Name: transforming growth factor, beta-induced, 68kDa
  ENST ID: ENST00000509485
  CDS Start-End: 1-179
ccaagacactatttgaattggctgcagagtctgatgtgtccacagccattgaccttttcagacaagccggcctcggcaatcatctctctggaagtgagcggttgaccctcctggctcccctgaattctgtattcaaaggagcacatctctctggacctaaccatcaccctttcttgtagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagagcttagcatttttgctgggtggagagagctggagcctggaatcactccctctttgtgcatacggagggcatgaaaaccaagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctg

SEQ ID NO: 192605 - DNA, 399 bp, Homo sapiens
  Payload ID: 18027
  Gene Name: transforming growth factor, beta-induced, 68kDa
  ENST ID: ENST00000503087
  CDS Start-End: 1-236
tccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccaggcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgc

SEQ ID NO: 192606 - DNA, 1173 bp, Homo sapiens
  Payload ID: 18027
  Gene Name: transforming growth factor, beta-induced, 68kDa
  ENST ID: ENST00000604555
  CDS Start-End: 1-660
cgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatgtaagttctgggtcctaaatcatgctcctgggaagctccttactgtgggacttgtattagtgtaaaaaaaaatgtcctcaataagcaggagtttgcatgagaactggttgctgacaaggaaggaaataatttctggaaaatatagataacaaaatgagatcctgcagaaggattggaatctctttttctggaggcctttgagaataaaccacacaattatccaacctgtattgtgaaggaataagtccttcttgaattcaggaattaacacctgggaggagggatggagttcagactctttctgagcttatgagaagagaagccccctaaactaaaatacagccctccttggtccaaaaggtgccttctctcttctgctgtatcttctttgttttcaaacccaacagttaccctggaaatcaaaaaggaagtacaactcaacatagctcttgcctgggaccaaccagcaccatttggctaaagatggttatcatctgttaaacaaagaaataaataaatgggttcaacgta

SEQ ID NO: 192607 - DNA, 6513 bp, Homo sapiens
  Payload ID: 18028
  Gene Name: transforming, acidic coiled-coil containing protein 1
  Uniprot ID: O75410
  ENST ID: ENST00000276520
  CDS Start-End: 321-1508
cagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 192608 - DNA, 7802 bp, Homo sapiens
  Payload ID: 18028
  Gene Name: transforming, acidic coiled-coil containing protein 1
  Uniprot ID: O75410
  ENST ID: ENST00000317827
  CDS Start-End: 380-2797
agctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgtta

SEQ ID NO: 192609 - DNA, 967 bp, Homo sapiens
  Payload ID: 18028
  Gene Name: transforming, acidic coiled-coil containing protein 1
  ENST ID: ENST00000521935
  CDS Start-End: 554-967
aagaaggtcgcgtgatgacaggcccctggcagctgctgggaaatggtggtctctgccgggctgtcatccgcgtgattgcggaaggcaggtgacaccattcttagcctcgggcccagggagttccagcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggcc

SEQ ID NO: 192610 - DNA, 1807 bp, Homo sapiens
  Payload ID: 18028
  Gene Name: transforming, acidic coiled-coil containing protein 1
  ENST ID: ENST00000521866
  CDS Start-End: 1-1688
gaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaa

SEQ ID NO: 192611 - DNA, 5509 bp, Homo sapiens
  Payload ID: 18028
  Gene Name: transforming, acidic coiled-coil containing protein 1
  Uniprot ID: O75410
  ENST ID: ENST00000520615
  CDS Start-End: 907-2739
acaggatgtttctgagccaagttgaagcaaaagaaactttttccagcatgtcaggaacgaagctgacgttccattaagaaaaaaaaaaaaaaaaaaagaagtgctagaggaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtggcgcagaagggagaggggagcgaccctggggaccgactctggggaccctcgccgaagagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaa

SEQ ID NO: 192612 - DNA, 493 bp, Homo sapiens
  Payload ID: 18028
  Gene Name: transforming, acidic coiled-coil containing protein 1
  ENST ID: ENST00000521642
  CDS Start-End: 95-493
tcctcccgccccaccgcctccccgcccagggtctgggcacagccgcccgccgcccagcacaggagggtgcagccccggccccaagttctgcgccatgggaggctcccactctcagaccccgaggggccgggaacccgccggggagaggcacccgagacccacggagaccgcgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgctt

SEQ ID NO: 192613 - DNA, 5510 bp, Homo sapiens
  Payload ID: 18028
  Gene Name: transforming, acidic coiled-coil containing protein 1
  ENST ID: ENST00000519416
  CDS Start-End: 911-2740
aaggacaggatgtttctgagccaagttgaagcaaaagaaactttttccagcatgtcaggaacgaagctgacgttccattaagaaaaaaaaaaaaaaaaaaagaagtgctagaggaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtggcgcagaagggagaggggagcgaccctggggaccgactctggggaccctcgccgaagagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataactggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaa

SEQ ID NO: 192614 - DNA, 3011 bp, Homo sapiens
  Payload ID: 18028
  Gene Name: transforming, acidic coiled-coil containing protein 1
  Uniprot ID: O75410
  ENST ID: ENST00000518415
  CDS Start-End: 707-2902
ggggaccgactctggggaccctcgccgaagagtcccaagggttccaaggccagagagaggtcctggtcttgattgctggcatgtttactcttccaagtacactgagatcaaatgcaaagacaaaccatcaaagaaaataactctaaaatctggacatgatatacaaagtgactgcctaaaggagctgaagagaggacataagtggatcgcctctgctgttgcatgttggcttggagaacagaagatgaggagccaaataagcaagtccttcagccccaggcttctagcacggggctgcatgtaggctatgcattctggggagtgaggagatcatgaatgctgaaaataaatgaaggaatccagaaaagcaagagtcaaagaaggcatctgcaggccaaatctctgatcaacccctgacccacatacacacaaaatacactcaaagcagctcagctaaagacaaagatctgcactcagagtagagctgcctccccagaaacagagctcgcagttcaggcccagcaagaaaattacctgcaaaacaaaggaaaaacaacactcatcagagaaaaagaacagaatctggaatcttcacaacctagcattcatcatatccaagattgaaacccaaattatgggacatatttaaaaaccaggaaaatggaacgtagtcttaagagaaaagtcaatcaaatctgacctggagatgaataatatattgaaacttaaaagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaa

SEQ ID NO: 192615 - DNA, 491 bp, Homo sapiens
  Payload ID: 18028
  Gene Name: transforming, acidic coiled-coil containing protein 1
  ENST ID: ENST00000521050
  CDS Start-End: 57-491
acagccgcccgccgcccagcacaggagggtgcagccccggccccaagttctgcgccatgggaggctcccactctcagaccccgaggggccgggaacccgccggggagaggcacccgagacccacggagaccgcgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgctt

SEQ ID NO: 192616 - DNA, 685 bp, Homo sapiens
  Payload ID: 18028
  Gene Name: transforming, acidic coiled-coil containing protein 1
  ENST ID: ENST00000524193
  CDS Start-End: 504-685
gtgcaaatgtgttgtgggccttgaggtggcagtcctatgaggcggtggtagggctttcccctgattcagtactcagctggtcccaaggggctttgagtgtggcttttgcctccttaactggatgctgaataggctccttgcacttattttgggactccgttgtgcctgtgcccagcacagggtgtgctgctggtgaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggaggg

SEQ ID NO: 192617 - DNA, 1550 bp, Homo sapiens
  Payload ID: 18028
  Gene Name: transforming, acidic coiled-coil containing protein 1
  ENST ID: ENST00000520611
  CDS Start-End: 324-1052
ttaacaagcagtgacttttgttctcccactggtaatcacgttaatgaaatcttagaatcacccaagaaggcaaagtcgcgtttaataacgatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaat

SEQ ID NO: 192618 - DNA, 4116 bp, Homo sapiens
  Payload ID: 18028
  Gene Name: transforming, acidic coiled-coil containing protein 1
  ENST ID: ENST00000518809
  CDS Start-End: 1-1364
gtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgactactgaacaagtgaaatttctctgttttctgttgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaacggcaatatgggactccctccaagctagggtttggcaagtctgccctagagtcatttactctcctctgcctccatttgttaatacagaatcaacatttagtcttcattatctttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctc

SEQ ID NO: 192619 - DNA, 1724 bp, Homo sapiens
  Payload ID: 18028
  Gene Name: transforming, acidic coiled-coil containing protein 1
  ENST ID: ENST00000522904
  CDS Start-End: 53-1724
ccgcccgccgcccagcacaggagggtgcagccccggccccaagttctgcgccatgggaggctcccactctcagaccccgaggggccgggaacccgccggggagaggcacccgagacccacggagaccgcctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagaggtaa

SEQ ID NO: 192620 - DNA, 476 bp, Homo sapiens
  Payload ID: 18028
  Gene Name: transforming, acidic coiled-coil containing protein 1
  ENST ID: ENST00000524354
  CDS Start-End: 90-476
agaaacagaaccctgtgtcaaatccaggagcctgggggactgtagaacctgaagttttactgggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactct

SEQ ID NO: 192621 - DNA, 656 bp, Homo sapiens
  Payload ID: 18028
  Gene Name: transforming, acidic coiled-coil containing protein 1
  ENST ID: ENST00000521528
  CDS Start-End: 566-656
agtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagca

SEQ ID NO: 192622 - DNA, 2564 bp, Homo sapiens
  Payload ID: 18028
  Gene Name: transforming, acidic coiled-coil containing protein 1
  ENST ID: ENST00000520973
  CDS Start-End: 566-2311
agtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgaggaaaattgtagctgaatatgaaaagactattgctcaaatgattgaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaagaatgaagaagccttgaagaaatgtgctcaggattacttagccagagttaaacaagaggagcagcgataccaggccctgaaaatccacgcagaagagaaactggacaaagccaatgaagagattgctcaggttcgaacaaaagcaaaggctgagagtgcagctctccatgctggactccgcaaagagcagatgaaggtggagtccctggaaagggccctgcagcagaagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggt

SEQ ID NO: 192623 - DNA, 1976 bp, Homo sapiens
  Payload ID: 18028
  Gene Name: transforming, acidic coiled-coil containing protein 1
  ENST ID: ENST00000520340
  CDS Start-End: 133-1875
gatgcgaaatcagcggtagcaggtggcgcagaagggagaggggagcgaccctggggaccgactctggggaccctcgccgaagagtcccaagggttccaaggccagagagaggtcctggtcttgattgctggcatgtttactcttccaagtacactgagatcaaatgcaaagacaaaccatcaaagctcggattctgaaggtaattttgagactcctgaagctgaaaccccgatccgatcacctttcaaggagtcctgtgatccatcactcggattggcaggacctggggccaaaagccaagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggaaagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgagtggctgtaaggtgaagaagcatgaaactcagtctctcgccctggatgcatgttctcgggatgaaggggcagtgatctcccagatttcagacatttctaatagggatggccatgctactgatgaggagaaactggcatccacgtcatgtggtcagaaatcagctggtgccgaggtgaaaggcatagagaaggagacgtgccagaagatggaagaagacgggtccactgtgcttgggctgctggagtcctctgcagagaaggcccctgtgtcggtgtcctgtggaggtgagagccccctggatgggatctgcctcagcgaatcagacaagacagccgtgctcaccttaataagagaagagataattactaaagagattgaagcaaatgaatggaagaagaaatacgaagagacccggcaagaagttttggagatgagaaaggagagttatgagccatgaaatgactaaagatgaaatcaaagtagagaagaaaaaaaggcataaataattcacacacagtgtggtcaacacttgaatgattaaaaaacattttaagtata

SEQ ID NO: 192624 - DNA, 3644 bp, Homo sapiens
  Payload ID: 18029
  Gene Name: transforming, acidic coiled-coil containing protein 2
  Uniprot ID: O95359
  ENST ID: ENST00000260733
  CDS Start-End: 82-3162
cgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttg

SEQ ID NO: 192625 - DNA, 9377 bp, Homo sapiens
  Payload ID: 18029
  Gene Name: transforming, acidic coiled-coil containing protein 2
  Uniprot ID: O95359
  ENST ID: ENST00000334433
  CDS Start-End: 47-8893
gtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagagcatctccccagctgctgcccatgcgggtcttcctccctcggctgcagaacacatagtttcgccatctgccccagctggtgacagagtagaagcttccactccctcctgcccagatccggccaaggacctcagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggc

SEQ ID NO: 192626 - DNA, 3815 bp, Homo sapiens
  Payload ID: 18029
  Gene Name: transforming, acidic coiled-coil containing protein 2
  Uniprot ID: O95359
  ENST ID: ENST00000358010
  CDS Start-End: 47-3331
gtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggc

SEQ ID NO: 192627 - DNA, 3979 bp, Homo sapiens
  Payload ID: 18029
  Gene Name: transforming, acidic coiled-coil containing protein 2
  Uniprot ID: O95359
  ENST ID: ENST00000360561
  CDS Start-End: 500-3490
gcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataa

SEQ ID NO: 192628 - DNA, 3879 bp, Homo sapiens
  Payload ID: 18029
  Gene Name: transforming, acidic coiled-coil containing protein 2
  ENST ID: ENST00000368999
  CDS Start-End: 336-3452
ccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccccccggcccccggctcgggccgcgagtcgcagctccctgccgccgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacgatggttgaagatgtgatgtctgtgtgttctctgtttgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaa

SEQ ID NO: 192629 - DNA, 3813 bp, Homo sapiens
  Payload ID: 18029
  Gene Name: transforming, acidic coiled-coil containing protein 2
  Uniprot ID: O95359
  ENST ID: ENST00000369000
  CDS Start-End: 1610-3325
ggaaagccctttgcacacatcggcctattgaagcactttgcttgattcagctattctcctctcaggacctgcctggatcatcccagcctgtagaatcctgggtttctgtggcagtttgttcttctggtatcacctgctatgctctgaatgtttgtatccctctcagccccgaaattcctgtgttgaaatcctaacccctaaggtgatggtatgaggaggtggggccttcgggaggtgattaggccataagggtggagcctttgtgaatgggattagtgcccttataaaaagaggccccacagcactgccttgcctcttctgccacgtgaagatgcagtgagaaggagctgtctgtgaactaggaaggggtcctcatgagacactgaacctgctggtgccttgatcttggacttcccagcctccagaactttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaata

SEQ ID NO: 192630 - DNA, 3685 bp, Homo sapiens
  Payload ID: 18029
  Gene Name: transforming, acidic coiled-coil containing protein 2
  ENST ID: ENST00000369001
  CDS Start-End: 1472-3199
gcctttcggggagccacgccggccctgcgccgttgtcccgggaaactttgcgtcccagggccgcaccggaccgtggtgaccccacgcgccgcgccgccaccgggctcggaaaacccagcgcccccgggctctttggcagttgcgactccgaacgaaggcggctccgtgcgggccatcccctatctccccgggcggttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccagtagagactgggtttcaccatgatgaccaggctggtctcaaactcctgacctcaagtgatctgcctgcctcggcctcccaaagtgctgggattacaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 192631 - DNA, 9673 bp, Homo sapiens
  Payload ID: 18029
  Gene Name: transforming, acidic coiled-coil containing protein 2
  Uniprot ID: O95359
  ENST ID: ENST00000369005
  CDS Start-End: 341-9187
caggagagaagaaacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagagcatctccccagctgctgcccatgcgggtcttcctccctcggctgcagaacacatagtttcgccatctgccccagctggtgacagagtagaagcttccactccctcctgcccagatccggccaaggacctcagcaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaa

SEQ ID NO: 192632 - DNA, 9158 bp, Homo sapiens
  Payload ID: 18029
  Gene Name: transforming, acidic coiled-coil containing protein 2
  ENST ID: ENST00000453444
  CDS Start-End: 47-8674
gtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaaggtcagcgaaagatattggtctttggaaggccatgatgccttccttagatacagacacactggatgttttggaaaggagagtagtccttatacagcatgagttcctacataagaaagaagcaaatggccattcccgttttatgtacagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggc

SEQ ID NO: 192633 - DNA, 2239 bp, Homo sapiens
  Payload ID: 18029
  Gene Name: transforming, acidic coiled-coil containing protein 2
  ENST ID: ENST00000514539
  CDS Start-End: 232-2239
agtgcccaggaatgcagaagccaggggatggacgagtactcaggctttcctcgaatctctgcttgagtggggcagcctcggggcctccggacgctggagaagctcacagcatctgtggccggtggtgcagctaacttttttggtgacattgaaagagatttaggtccaagagatacgagcaggggaattaggggtgggaatttgggggacagaggctgttcttcagcggaaatggcctatgcctcctggcagaggtggtccccagtggaatgggcccggtggatgtggacagcggtgaccagcagtggggactccagtctgctggtgcttcagggagactctggaaaaaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcag

SEQ ID NO: 192634 - DNA, 1048 bp, Homo sapiens
  Payload ID: 18029
  Gene Name: transforming, acidic coiled-coil containing protein 2
  ENST ID: ENST00000440764
  CDS Start-End: 1-554
aacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaagtgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgagga

SEQ ID NO: 192635 - DNA, 1229 bp, Homo sapiens
  Payload ID: 18029
  Gene Name: transforming, acidic coiled-coil containing protein 2
  ENST ID: ENST00000496913
  CDS Start-End: 1-1229
tccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctcca

SEQ ID NO: 192636 - DNA, 3667 bp, Homo sapiens
  Payload ID: 18029
  Gene Name: transforming, acidic coiled-coil containing protein 2
  ENST ID: ENST00000369004
  CDS Start-End: 152-3178
cgctcccgccgccacggatgcccgcagctgctcccctctgcagtgcagcaaccccggccgccggccggctcgccccggctcccggctgcaggaatcgcgccaggacgctggccccgctcgcggctagcttgcacgccagggcacagcgaggatgggagggtcgcagtccctgcagccagccccagccagcgacctgaacctggaggcttccgaggcaatgagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacgatggttgaagatgtgatgtctgtgtgttctctgtttgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataa

SEQ ID NO: 192637 - DNA, 547 bp, Homo sapiens
  Payload ID: 18029
  Gene Name: transforming, acidic coiled-coil containing protein 2
  ENST ID: ENST00000491540
  CDS Start-End: 1-547
gaacagcacctcggacaaccagcaggaggactccgtcttgcataacgtcattctgtggcctccaaaccctgagcccacacagaggactttatcagctcagactccaaggtccgcgcagccacccgggaacagtcagaatataaaaaggaagcagcaggacacgcccggaagccctgaccacagagacgcgtccagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgcc

SEQ ID NO: 192638 - DNA, 741 bp, Homo sapiens
  Payload ID: 18029
  Gene Name: transforming, acidic coiled-coil containing protein 2
  ENST ID: ENST00000490979
  CDS Start-End: 1-461
agatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccggttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttg

SEQ ID NO: 192639 - DNA, 9245 bp, Homo sapiens
  Payload ID: 18029
  Gene Name: transforming, acidic coiled-coil containing protein 2
  ENST ID: ENST00000515273
  CDS Start-End: 329-8956
aacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaaggtcagcgaaagatattggtctttggaaggccatgatgccttccttagatacagacacactggatgttttggaaaggagagtagtccttatacagcatgagttcctacataagaaagaagcaaatggccattcccgttttatgtacagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggcc

SEQ ID NO: 192640 - DNA, 4114 bp, Homo sapiens
  Payload ID: 18029
  Gene Name: transforming, acidic coiled-coil containing protein 2
  Uniprot ID: O95359
  ENST ID: ENST00000513429
  CDS Start-End: 341-3625
caggagagaagaaacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattacagctcccgagggctcctttgcctctgctgacgccctcctcagcaggctagctcaccccgtctctctctgtggtgcacttgactatctggagcccgacttagcagaaaagaaccccccactattcgctcagaaactccaggaggagttagagtttgccatcatgcggatagaagccctgaagctggccaggcagattgctttggcttcccgcagccaccaggatgccaagagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttcaaataaaattctctattgtaaataaaattttttctttggatcttggcaataa

SEQ ID NO: 192641 - DNA, 497 bp, Homo sapiens
  Payload ID: 18029
  Gene Name: transforming, acidic coiled-coil containing protein 2
  ENST ID: ENST00000508411
  CDS Start-End: 1-497
aagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgagggtaagcaactctgtagccagctggacccccactctgcctcggagaatcctgcccctagggagccaaaggccaggagagaaacttctcagccagagttggattacagaaactcctatgaaattgaatatatggagaaaattggctcctccttacctcaggacgacgatgccccgaagaagcaggccttgtaccttatgtttgacacttctca

SEQ ID NO: 192642 - DNA, 567 bp, Homo sapiens
  Payload ID: 18029
  Gene Name: transforming, acidic coiled-coil containing protein 2
  ENST ID: ENST00000505639
  CDS Start-End: 1-567
gagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtg

SEQ ID NO: 192643 - DNA, 9101 bp, Homo sapiens
  Payload ID: 18029
  Gene Name: transforming, acidic coiled-coil containing protein 2
  ENST ID: ENST00000515603
  CDS Start-End: 329-8809
aacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagcattggcagcgttgggcttggaggcttctgcaccgcttctgagagttctgccagcctggatccatgccttgtgtccccagaggtgactgagccaaggaaggacccacagggagccagggggccagaaggttctttgctgcccagcccaccaccgtcccaggagcgagagcacccctcgtcctccatgccctttgccgagtgtcccccggaaggttgcttggcaagtccagcagcggcacctgaagatggtcctcagactcagtctcccaggagggaacctgccccaaatgccccaggagacatcgcggcggcatttcccgctgagagggacagctctactccataccaagagattgctgccgtccccagtgctggaagagagagacagccgaaggaagaaggacagaagtcctccttctccttctccagtggcatcgaccagtcacctggaatgtcgccagtacccctcagagagccaatgaaggcaccgctgtgtggagagggggaccagcctggtggttttgagtcccaagagaaagaggctgcaggtggctttccccctgcagagtccaggcagggggtggcttctgtgcaagtgacccctgaggcccctgctgcagcccagcagggcacagaaagctcagcggtcttggagaagtcccccctaaaacccatggccccgatcccacaagatccagccccaagagcctcagacagagaaagaggccaaggggaggcgccgcctcagtatttaacagatgacttggaattcctcagggcctgccatctccctaggagcaattcaggggctgccccagaagcagaagtgaatgccgcttcccaggagagctgccagcagccagtgggagcatatctgccgcacgcagagctgccctggggcttgccaagtcctgccctggtgccagaggctgggggctctgggaaggaggctctggacaccattgatgttcagggtcacccacagacagggatgcgaggaaccaagcccaatcaagttgtctgtgtggcagcaggcggccagcccgaagggggtttgcctgtgagccctgaaccttccctgctcactccgactgaggaagcacatccagcttcaagcctcgcttcattcccagctgctcagattcctattgctgtagaagaacctggatcatcatccagggaatcagtttccaaggctgggatgccagtttctgcagatgcagccaaagaggtggtggatgcagggttggtgggactggagaggcaggtgtcagatcttggaagcaagggagagcatccagaaggggaccctggagaggttcctgccccatcaccccaggagaggggagagcacttgaacacggagcaaagccatgaggtccaaccaggagtaccaccccctcctcttcccaaggagcaaagccatgaggtccaaccaggagcaccaccccctcctcttcccaaggcaccaagtgaaagtgccagagggccaccggggccaacggatggagccaaggtccatgaagattccacaagcccagccgtggctaaagaaggaagcagatcacctggtgacagccctggaggaaaggaggaagccccagagccacctgatggtggagacccagggaacctgcaaggagaggactctcaggctttcagcagcaagcgtgatccagaagtaggcaaagatgagctttcaaagccaagcagtgatgcagagagcagagaccatcccagctcacactcagcacagccacccagaaaggggggtgctgggcacacggacgggccccactctcagacagcagaggctgatgcatctggcctaccacacaagctgggtgaggaggaccccgtcctgccccctgtgccagatggagctggtgagcccactgttcccgaaggagccatctgggaggggtcaggattgcagcccaaatgtcctgacacccttcagagcagggaaggattgggaagaatggagtctttcctgactttagaatcagagaaatcagattttccaccaactcctgttgcagaggttgcacccaaagcccaggaaggtgagagcacattggaaataaggaagatgggcagctgtgatggggagggcttgctgacgtccccagatcaaccccgcgggccggcgtgtgatgcgtcgagacaggaatttcatgctggggtgccacatcccccccagggggagaacttggcagcagacctggggctcacggcactcatcctggaccaagatcagcagggaatcccatcctgcccaggggaaggctggataagaggagctgcatccgagtggcccctactatcttctgagaagcatctccagccatcccaggcacaaccagagacatccatctttgacgtgctcaaggagcaggcccagccacctgaaaatgggaaagagacttctccaagccatccaggttttaaggaccagggagcagattcttcccaaatccatgtacctgtggaacctcaggaagataacaacttgcccactcatggaggacaggagcaggctttgggatcagaacttcaaagtcagctccccaaaggcaccctgtctgatactccaacttcatctcccactgacatggtttgggagagttctctgacagaagagtcagaattgtcagcaccaacgagacagaagttgcctgcactaggggagaagcggccagagggagcatgcggtgatggtcagtcctcgagggtctcgcctccagcagcagatgtcttaaaagacttttctcttgcagggaacttcagcagaaaggaaacttgctgcactgggcaggggccaaacaagtctcaacaggcattggctgatgccttggaagaaggcagccagcatgaagaagcatgtcaaaggcatccaggagcttctgaagcagctgatggttgttccccactctggggcttgagtaagagggagatggcaagtggaaacacaggggaggccccaccttgtcagcctgactcagtagctctcctggatgcagttccctgcctgccagccctggcgcccgccagccccggagtcacacccacccaggatgccccagagacagaggcatgtgatgaaacccaggaaggcaggcagcaaccagtgccggccccgcagcagaaaatggagtgctgggccacttcggatgcagagtccccaaagcttcttgcaagtttcccatcagctggggagcaaggtggtgaagccggggctgctgagactggtggcagcgctggtgcaggagacccaggaaagcagcaggctccggagaaacctggagaagctactttgagttgtggcctccttcagactgagcactgccttacctccggggaggaagcttctacctctgccctacgtgagtcctgccaagctgagcaccccatggccagctgccaggatgccttgctgccagccagagagctgggtgggattcccaggagcaccatggatttttctacacaccaggctgtcccagacccaaaggagctcctgctgtctgggccaccagaagtggctgctcctgacaccccttacctgcatgtcgacagtgctgcccagagaggagcagaagacagtggagtgaaagctgtttcctctgcagaccccagagctcctggcgaaagcccctgtcctgtaggggagcccccacttgccttggaaaatgctgcctccttgaagctgtttgctggctccctcgcccccctgttgcaaccaggagctgcaggtggggaaatccctgcagtgcaagccagcagtggtagtcccaaagccagaaccactgagggaccagtggactccatgccatgcctggaccggatgccacttctggccaagggcaagcaggcaacaggggaagagaaagcagcaacagctccaggtgcaggtgccaaggccagtggggagggcatggcaggtgatgcagcaggagagacagagggcagcatggagaggatgggagagccttcccaggacccaaagcagggcacatcaggtggtgtggacacaagctctgagcaaatcgccaccctcactggcttcccagacttcagggagcacatcgccaagatcttcgagaagcctgtgctcggagccctggccacacctggagaaaaggcaggagctgggaggagtgcagtgggtaaagacctcaccaggccattgggcccagagaagcttctagatgggcctccaggagtggatgtcacccttctccctgcacctcctgctcgactccaggtggagaagaagcaacagttggctggagaggctgagatttcccatctggctctgcaagatccagcttcagacaagcttctgggtccagcagggctgacctgggagcggaacttgccaggtgccggtgtggggaaggagatggcaggtgtcccacccacactgagggaagacgagaggccagaggggcctggggcagcctggccaggcctggaaggccaggcttactcacagctggagaggagcaggcaggaattagcttcaggtcttccttcaccagcagctactcaggagctccctgtggagagagctgctgccttccaggtggctccccatagccatggagaagaggccgtggcccaagacagaattccttctggaaagcagcaccaggaaacatctgcctgcgacagtccacatggagaagatggtcccggggactttgctcacacaggggttccaggacatgtgccaaggtccacgtgtgccccttctcctcagagggaggttttgactgtgcctgaggccaacagtgagccctggacccttgacacgcttgggggtgaaaggagacccggagtcactgctggcatcttggaaatgcgaaatgccctgggcaaccagagcacccctgcaccaccaactggagaagtggcagacactcccctggagcctggcaaggtggcaggcgctgctggggaagcagagggtgacatcaccctgagcacagctgagacacaggcatgtgcgtccggtgatctgcctgaagcaggtactacgaggacattctccgttgtggcaggtgacttggtgctgccaggaagctgtcaggacccagcctgctctgacaaggctccggggatggagggtacagctgcccttcatggggacagcccagccaggccccagcaggctaaggagcagccagggcctgagcgccccattccagctggggatgggaaggtgtgcgtctcctcacctccagagcctgacgaaactcacgacccgaagctgcaacatttggctccagaagagctccacactgacagagagagccccaggcctggcccatccatgttaccttcggttcctaagaaggatgctccaagagtcatggataaagtcacttcagatgagaccagaggtgcggaaggaacagaaagttcacctgtggcagatgatatcatccagcccgctgcccccgcagacctggaaagcccaaccttagctgcctcttcctaccacggtgatgttgttggccaggtctctacggatctgatagcccagaggagttccgattctgaagaggcatttgagaccccggagtcaacgacccctgtcaaagctccgccagctccacccccaccaccccccgaagtcatcccagaacccgaggtcagcacacagccacccccggaagaaccaggatgtggttctgagacagtccctgtccctgatggcccacggagcgactcggtggaaggaagtcccttccgtcccccgtcacactccttctctgccgtcttcgatgaagacaagccgatagccagcagtgggacttacaacttggactttgacaacattgagcttgtggatacctttcagaccttggagcctcgtgcctcagacgctaagaatcaggagggcaaagtgaacacacggaggaagtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagactgacacatttagggtgaaaaagtcgccaaaacggtctcctctctctgatccaccttcccaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgaggagttggattacagaaactcctatgaaattgaatatatggagaaaattggctcctccttacctcaggacgacgatgccccgaagaagcaggccttgtaccttatgtttgacacttctcaggagagccctgtcaagtcatctcccgtccgcatgtcagagtccccgacgccgtgttcagggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattagagaggctgctcacccaacagacgtctccatctccaaaacagccttgtactcccgcatcgggaccgctgaggtggagaaacctgcaggccttctgttccagcagcccgacctggactctgccctccagatcgccagagcagagatcataaccaaggagagagaggtctcagaatggaaagataaatatgaagaaagcaggcgggaagtgatggaaatgaggaaaatagtggccgagtatgagaagaccatcgctcagatgatagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttg

SEQ ID NO: 192644 - DNA, 964 bp, Homo sapiens
  Payload ID: 18029
  Gene Name: transforming, acidic coiled-coil containing protein 2
  ENST ID: ENST00000635597
  CDS Start-End: 1-527
gggaagtgatggaaatgaggaaaatagtggccgagtatgagaagaccatcgctcagatgataggcaagcctgaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaagaatgaagaggtgttgaagagatgtgcgcaggagtacctgtcccgggtgaagaaggaggagcagaggtaccaggccctgaaggtgcacgcggaggagaaactggacagggccaatgctgagattgctcaggttcgaggcaaggcccagcaggagcaagccgcccaccaggccagcctgcggaaggagcagctgcgagtggacgccctggaaaggacgctggagcagaagaataaagaaatagaagaactcaccaagatttgtgacgaactgattgccaaaatggggaaaagctaactctgaaccgaatgttttggacttaactgttgcgtgcaatatgaccgtcggcacactgctgttcctccagttccatggacaggttctgttttcactttttcgtatgcactactgtatttcctttctaaataaaattgatttgattgtatgcagtactaaggagactatcagaatttcttgctattggtttgcattttcctagtataattcatagcaagttgacctcagagttcctgtatcagggagattgtctgattctctaataaaagacacattgctgaccttggccttgccctttgtacacaagttcccagggtgagcagcttttggatttaatatgaacatgtacagcgtgcatagggactcttgccttaaggagtgtaaacttgatctgcatttgctgatttgtttttaaaaaaacaagaaatgcatgtttc

SEQ ID NO: 192645 - DNA, 2781 bp, Homo sapiens
  Payload ID: 18030
  Gene Name: transforming, acidic coiled-coil containing protein 3
  Uniprot ID: Q9Y6A5
  ENST ID: ENST00000313288
  CDS Start-End: 107-2623
cggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgcgggtgtgggcacccccgtgccagcagatggcactcagacccttacctgtgcacacacctctgctcctgagagcacagccccaaccaaccacctggtggctggcagggccatgaccctgagtcctcaggaagaagtggctgcaggccaaatggccagctcctcgaggagcggacctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaa

SEQ ID NO: 192646 - DNA, 778 bp, Homo sapiens
  Payload ID: 18030
  Gene Name: transforming, acidic coiled-coil containing protein 3
  ENST ID: ENST00000458173
  CDS Start-End: 115-778
agagattatgcaggcttgggttttctttctcaccatctcagcctgaaggccctttagctcttggtcccaggaagcagcagtgctgcccatggctccccctgccaggctggagaaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgagg

SEQ ID NO: 192647 - DNA, 825 bp, Homo sapiens
  Payload ID: 18030
  Gene Name: transforming, acidic coiled-coil containing protein 3
  ENST ID: ENST00000493975
  CDS Start-End: 134-825
ccgccgccagaacctgtaccgcgccctgtcatgggacccggccctagaccgaccgccgggctgggccccctggatggtggccaggggcggctagagctgggccaagaccgacggcggagcgggcgccccgagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacgg

SEQ ID NO: 192648 - DNA, 966 bp, Homo sapiens
  Payload ID: 18030
  Gene Name: transforming, acidic coiled-coil containing protein 3
  ENST ID: ENST00000467746
  CDS Start-End: 111-302
gcgacggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgctctcctcctcactccgcaacaggtgacttttcagacacctctgcgggatccacagacgcacaggattctaagtcctagcatggccagcaaacttgaggctcctttcactcaggatgacacccttggactggaaaactcacacccggtctggacacagaaagagaaccaacagctcatcaaggaagtggatgccaaaactactcatggaattctacagaaaccagtggaggctgacaccgacctcctgggggatgcaagcccagcctttgggagtggcagctccagcgagtctggcccaggtgccctggctgacctggactgctcaagctcttcccagagcccaggaagttctgagaaccaaatggtgtctccaggaaaagtgtctggcagccctgagcaagccgtggaggaaaaccttagttcctattccttagacagaagagtgacacccgcctctgagaccctagaagacccttgcaggacagagtcccagcacaaagcggagactccgcacggagccgaggaagaatgcaaagcggagactccgcacggagccgaggaggaatgccggcacggtggggtctgtgctcccgcagcagtggccacttcgcctcctggtgcaatccctaaggaagcctgcggaggagcacccctgcagggtctgcctggcgaagccctgggctgccctgc

SEQ ID NO: 192649 - DNA, 726 bp, Homo sapiens
  Payload ID: 18030
  Gene Name: transforming, acidic coiled-coil containing protein 3
  ENST ID: ENST00000485989
  CDS Start-End: 146-726
ctccggcgcgccggcggccatcaagggctagaagcgcgacggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggcctt

SEQ ID NO: 192650 - DNA, 650 bp, Homo sapiens
  Payload ID: 18030
  Gene Name: transforming, acidic coiled-coil containing protein 3
  ENST ID: ENST00000470136
  CDS Start-End: 1-650
acctgtaaaactagaatttgatgtatctgatggcgccaccagcaaaagggcacccccaccaaggagactgggagagaggtccggcctcaagcctcccttgaggaaagcagcagtgaggcagcaaaaggccccgcaggaggtggaggaggacgacggtaggagcggagcaggagaggacccccccatgccagcttctcggggctcttaccacctcgactgggacaaaatggatgacccaaacttcatcccgttcggaggtgacaccaagtctggttgcagtgaggcccagcccccagaaagccctgagaccaggctgggccagccagcggctgaacagttgcatgctgggcctgccacggaggagccaggtccctgtctgagccagcagctgcattcagcctcagcggaggacacgcctgtggtgcagttggcagccgagaccccaacagcagagagcaaggagagagccttgaactctgccagcacctcgcttcccacaagctgtccaggcagtgagccagtggattacctggagcagtttggaacttcctcgtttaaggagtcggccttgaggaagcagtccttatacctcaagttcgaccccctcctgagggacagtcctggtagaccagtgcccgtggccaccgaga

SEQ ID NO: 192651 - DNA, 1756 bp, Homo sapiens
  Payload ID: 18030
  Gene Name: transforming, acidic coiled-coil containing protein 3
  ENST ID: ENST00000612220
  CDS Start-End: 156-593
gcgtttgaaactccggcgcgccggcggccatcaagggctagaagcgcgacggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaagcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaatttaaacactg

SEQ ID NO: 192652 - DNA, 1693 bp, Homo sapiens
  Payload ID: 18030
  Gene Name: transforming, acidic coiled-coil containing protein 3
  ENST ID: ENST00000617535
  CDS Start-End: 101-538
tagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgtctgttcttcgtgtgtcacagaaagaaaatgtgccacccaagaacctggccaaagctatgaaggtgacttttcagacacctctgcgggatccacagacgcacaggattctaagtcctagcatggccagcaaacttgaggctcctttcactcaggatgacacccttggactggaaaactcacacccggtctggacacagaaagagaaggcagctgcattcagcctcagcggaggacacgcctgtggtgcagttggcagccgagaccccaacagcagagagcaaggagagagccttgaactctgccagcacctcgcttcccacaagctgtccaggcagtgagccagtgcccacccatcagcaggggcagcctgccttggagctgaaagaggagagcttcagagaccccgctgaggttctaggcacgggcgcggaggtggattacctggagcagtttggaacttcctcgtttaaggagtcggccttgaggaagcagtccttatacctcaagttcgaccccctcctgagggacagtcctggtagaccagtgcccgtggccaccgagaccagcagcatgcacggtgcaaatgagactccctcaggacgtccgcgggaagccaagcttgtggagttcgatttcttgggagcactggacattcctgtgccaggcccacccccaggtgttcccgcgcctgggggcccacccctgtccaccggacctatagtggacctgctccagtacagccagaaggacctggatgcagtggtaaaggcgacacaggaggagaaccgggagctgaggagcaggtgtgaggagctccacgggaagaacctggaactggggaagatcatggacaggttcgaagaggttgtgtaccaggccatggaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaagaacgaagagtcactgaagaagtgcgtggaggattacctggcaaggatcacccaggagggccagaggtaccaagccctgaaggcccacgcggaggagaagctgcagctggcaaacgaggagatcgcccaggtccggagcaaggcccaggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttttttctgtcttgtcttcaacttttttaaaaactagattgctttgaaaacatgactcaataaaagtttcctttcaattt

SEQ ID NO: 192653 - DNA, 1477 bp, Homo sapiens
  Payload ID: 18031
  Gene Name: transgelin
  Uniprot ID: Q01995
  ENST ID: ENST00000278968
  CDS Start-End: 449-1054
caagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaa

SEQ ID NO: 192654 - DNA, 928 bp, Homo sapiens
  Payload ID: 18031
  Gene Name: transgelin
  Uniprot ID: Q01995
  ENST ID: ENST00000392951
  CDS Start-End: 125-730
acatcaccacggcggcagccctttaaacccctcacccagccagcgccccatcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaag

SEQ ID NO: 192655 - DNA, 375 bp, Homo sapiens
  Payload ID: 18031
  Gene Name: transgelin
  ENST ID: ENST00000529792
  CDS Start-End: 101-375
gtgtgctcactcctatttgggaagagagaaggggcacagcagccctgcaggggcccctggctctgctcgtgtttctgggcttctgctgctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatgga

SEQ ID NO: 192656 - DNA, 1227 bp, Homo sapiens
  Payload ID: 18031
  Gene Name: transgelin
  Uniprot ID: Q01995
  ENST ID: ENST00000530649
  CDS Start-End: 205-810
aggggtctcaccagagagggagccgggggagtgcgctcctgcgtccatcctcagaccagcgtgtccctcccaacctctgacccctctgaggccaggggatgggttcggcttcctttggtacctcttttggaagtctcttcagacaaacactggagagaaggcacagcaccctagggtgacatcagtggacagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaa

SEQ ID NO: 192657 - DNA, 1048 bp, Homo sapiens
  Payload ID: 18031
  Gene Name: transgelin
  Uniprot ID: Q01995
  ENST ID: ENST00000525531
  CDS Start-End: 261-866
cgaacccagacacaagtcttcactccttcctgcgagccctgaggaagccttactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagccca

SEQ ID NO: 192658 - DNA, 2166 bp, Homo sapiens
  Payload ID: 18031
  Gene Name: transgelin
  Uniprot ID: Q01995
  ENST ID: ENST00000532870
  CDS Start-End: 1142-1747
cttttggaagtctcttcagacaaacactggagagaaggcacagcaccctagggtgacatcagtggacaggtcagtttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactcaggctactccgtaagggtagccttacgagagcgtaagggcatgaggggaagtcgatgggtagaccaggtgtctctgatttctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaa

SEQ ID NO: 192659 - DNA, 501 bp, Homo sapiens
  Payload ID: 18031
  Gene Name: transgelin
  ENST ID: ENST00000529622
  CDS Start-End: 1-455
gcccagaccgtgggcgcttgggcttccagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttgg

SEQ ID NO: 192660 - DNA, 709 bp, Homo sapiens
  Payload ID: 18032
  Gene Name: transgelin 2
  Uniprot ID: P37802
  ENST ID: ENST00000320307
  CDS Start-End: 87-686
cctccccccgcgccctgtgcctcctggggctacctgaagccggtgtcctgggagatctctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctg

SEQ ID NO: 192661 - DNA, 1603 bp, Homo sapiens
  Payload ID: 18032
  Gene Name: transgelin 2
  Uniprot ID: P37802
  ENST ID: ENST00000368096
  CDS Start-End: 248-910
cggtggtgaggggctgccctacggtggttcccttaattgtgggccgccccccatccttgctgctggctgtggcacctcgctctgtgggctggtgccctcactgtgctgctctttgagaacactccctgtcccaaatctgagttgggaagttctcctgtgttccatctgcacggtggatggagagtccctttgtcttcccaattaaacaccctagccaagaaccctgaagtcctccctgcccccacccatgtccgccttttctttggctttggctttggtgagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatgga

SEQ ID NO: 192662 - DNA, 1604 bp, Homo sapiens
  Payload ID: 18032
  Gene Name: transgelin 2
  Uniprot ID: P37802
  ENST ID: ENST00000368097
  CDS Start-End: 312-911
tggaggctgaggtactcacgggtggagaccactgcagccgcctttgtagattcagactccccgaacctttaacccttgctctggtctactgtccctctgtctcaagcagtcctccctccttctgcgctgcggcgcctttaaaccttcttggcccttgccccgccccgggtccgccccgtctgaggcgggaccctcctgaaaatccccggctgggcagggcgcaccacttgcagctgcagcccttgccttgagtcagtgcgccgctctccagcccgcttgaacgctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatgga

SEQ ID NO: 192663 - DNA, 801 bp, Homo sapiens
  Payload ID: 18032
  Gene Name: transgelin 2
  ENST ID: ENST00000397334
  CDS Start-End: 240-801
agacagggcgtccgtctggagcagggactcagggactgagccccacccgcgggctccatcgctgagtcctcactggggcgaggggaaaaaagggcgtcggactttagctggctggccccgagtgaccccgggtcgtggcgccggccctgggccagctcgtgctcctgggctttcccgcgcgacccttcacttcctggttccaggagcacgtctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcag

SEQ ID NO: 192664 - DNA, 1349 bp, Homo sapiens
  Payload ID: 18033
  Gene Name: transgelin 3
  Uniprot ID: Q9UI15
  ENST ID: ENST00000273368
  CDS Start-End: 418-1017
gtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtg

SEQ ID NO: 192665 - DNA, 1488 bp, Homo sapiens
  Payload ID: 18033
  Gene Name: transgelin 3
  Uniprot ID: Q9UI15
  ENST ID: ENST00000393917
  CDS Start-End: 553-1152
gtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattgtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtctt

SEQ ID NO: 192666 - DNA, 1164 bp, Homo sapiens
  Payload ID: 18033
  Gene Name: transgelin 3
  Uniprot ID: Q9UI15
  ENST ID: ENST00000455401
  CDS Start-End: 235-834
ccggaggtttattctagagttactggcgggtagctgtgcttttctttcccgtttgtaggtgaaaccccattggcttcattggctccttgatttaaaccacgcccggctttctgccctctttgctgctgctgggccaggttgcccagccatatcccagccccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttg

SEQ ID NO: 192667 - DNA, 920 bp, Homo sapiens
  Payload ID: 18033
  Gene Name: transgelin 3
  ENST ID: ENST00000486460
  CDS Start-End: 243-590
ggaatggcgctcccaggctacaggaatctctgtagtaaggagcagcattaggaatggggtcctctgggtctttggggcttagtataggagcctggctacacagcccagagcccgtgccttcctagggcccatgacttgctcctgcccaaactggatgagcagtgtcccacgtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttg

SEQ ID NO: 192668 - DNA, 1301 bp, Homo sapiens
  Payload ID: 18033
  Gene Name: transgelin 3
  Uniprot ID: Q9UI15
  ENST ID: ENST00000478951
  CDS Start-End: 454-1053
ggggaaagtagcttggctattcccgacagatggacagttggtagaacggaccctcccacaggccctcatccccttgtgcagctgctggcctcgtagacaatcggctgtctccccagaagagggaaagaattgtgcagatgagaaagaggctctcagcgggagggaggcaggcgggcttgattgacacaggagagggctggctttttggagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttga

SEQ ID NO: 192669 - DNA, 648 bp, Homo sapiens
  Payload ID: 18033
  Gene Name: transgelin 3
  ENST ID: ENST00000469385
  CDS Start-End: 1-237
gtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaaggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgt

SEQ ID NO: 192670 - DNA, 566 bp, Homo sapiens
  Payload ID: 18033
  Gene Name: transgelin 3
  ENST ID: ENST00000494932
  CDS Start-End: 76-566
ccgtctgcagggagccggaggctgctgctgctgctattgtgtggatgccgcgcgtgtcttctcttctttccagagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggaaagcccagcagaatcggagaggcttttccgaggagcagcttcgccagggacagaacgtaataggcctgcagatgggcagcaacaagggagcctcccaggcgggcatgacagggtacgggatgcccaggcagatcatgtaggacgcggcatcctgcccctggtagagaggacgaatgttccacaccatggtctctacgaaaaagaaatagttagtcaccttctgaccttctcctctttctcaaagccttctgtccctggtttttgcaagtgctgcatttccgccgagaatccgcgttgcctactgctgcc

SEQ ID NO: 192671 - DNA, 1177 bp, Homo sapiens
  Payload ID: 18033
  Gene Name: transgelin 3
  ENST ID: ENST00000617143
  CDS Start-End: 247-912
gagggctcttagcaacggccctggttgagccccctcagccatgagaaaatcaaatcaatgtgccattcttccaggcgcgaggcagcagcggctgcagttcaacatgaaaggaggcttcctccctgcctgctaattacctgctcttcccgatctcatcgtttctgcctttgcaaagtgctactgagaagggggaagaaacgtccgccacccatcccccttgctgcctgggggttcagacttgattagatggctaacaggggcccgagctatggcttaagccgagaggtgcaggagaagatcgagcagaagtatgatgcggacctggagaacaagctggtggactggatcatcctgcagtgcgccgaggacatagagcacccgccccccggcagggcccattttcagaaatggttaatggacgggacggtcctgtgcaagctgataaatagtttatacccaccaggacaagagcccatacccaagatctcagagtcaaagatggcttttaagcagatggagcaaatctcccagttcctaaaagctgcggagacctatggtgtcagaaccaccgacatctttcagacggtggatctatgggaagggaaggacatggcagctgtgcagaggaccctgatggctttaggcagcgttgcagtcaccaaggatgatggctgctatcggggagagccatcctggtttcacaggaaagcccagcagaatcggagaggcttttccgaggagcagcttcgccagggacagaacgtaataggcctgcagatgggcagcaacaagggagcctcccaggcgggcatgacagggtacgggatgccaggcagatcatgtaggacgcggcatctgcccctggtagagaggacgaatgttccacaccatggtctctacgaaaagaaatagttagtcaccttctgaccttctcctctttctcaaagccttctgtccctggtttttgcaagtgctgcatttccgccgagaatccgcgttgcctactgctgccacctcctgttcatttagaactatgcaaagactccgcttccgttttcctgagctcctcgggccccagagtctctgtttgattatttatttatttatttatttatttgccaaaaattctcctcttcaacttatagaatgcacctaataaagtaattagtcttgtgtc

SEQ ID NO: 192672 - DNA, 2777 bp, Homo sapiens
  Payload ID: 18034
  Gene Name: transglutaminase 1
  Uniprot ID: P22735
  ENST ID: ENST00000206765
  CDS Start-End: 125-2578
acataagtcacttaccaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccccgtgccaggagcaatgggactggagtcagatgagcaaggacattgccccaagataggggcacactacagagcagctccccaggagctcaggtggggagtccagggctcccggagggggagtccagggctcccggagagggagtcagtcttcacttgcactgggggaacagatgctaataaactgttttttaatgaa

SEQ ID NO: 192673 - DNA, 1581 bp, Homo sapiens
  Payload ID: 18034
  Gene Name: transglutaminase 1
  Uniprot ID: P22735
  ENST ID: ENST00000544573
  CDS Start-End: 349-1476
ggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccccgtgccaggagcaatgggactggagtcagatgagcaaggacattgccccaagataggggcacactacagagcagctccccaggagctcaggtggggagtcca

SEQ ID NO: 192674 - DNA, 469 bp, Homo sapiens
  Payload ID: 18034
  Gene Name: transglutaminase 1
  ENST ID: ENST00000561067
  CDS Start-End: 442-469
acccccgggcaggttctggtgcttggagctggacaagaaaaggcagtgtgggtgtggagggctccctgccagttcctggggcctctctgtccccactccccacggcacctccctgcctgatgcatcaccaaacagcccctcctggattctgtttccttgtgtcttcttgtcggcctgtttttactgtcttctgctaggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggcatgatggatgggccacgttccgatgtgg

SEQ ID NO: 192675 - DNA, 527 bp, Homo sapiens
  Payload ID: 18034
  Gene Name: transglutaminase 1
  ENST ID: ENST00000560443
  CDS Start-End: 334-527
gtcggcctgtttttactgtcttctgctaggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggttggagaaaagggaatcctctagtccaactgagcagagactcctctcagtgagagaaaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaacc

SEQ ID NO: 192676 - DNA, 562 bp, Homo sapiens
  Payload ID: 18034
  Gene Name: transglutaminase 1
  ENST ID: ENST00000560478
  CDS Start-End: 412-562
taggcggcccatgggcagagctgggacactagtgggaaggaaggaaagaaggaagaaggccctggctgacgggcctgaggacaagacccaaggagagcctccctgaagatgcctagcctcctcctctctaccttgggatcgccttggtgccatcctcagtgtttccccagtgacggggtggagtaaggatgcacacagcacaggtgcctgagccggttggtctggattcccaggaagaattccaggttggagaaaagggaatcctctagtccaactgagcagagactcctctcagtgagagaaaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgct

SEQ ID NO: 192677 - DNA, 898 bp, Homo sapiens
  Payload ID: 18034
  Gene Name: transglutaminase 1
  ENST ID: ENST00000559136
  CDS Start-End: 271-898
ttttcttctgtggacatgagtcctgcagaactggccagaagtaggtgaggcccagggagagaactggagggaaccagttttgtgtgttctggggacacagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggcgtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtgg

SEQ ID NO: 192678 - DNA, 412 bp, Homo sapiens
  Payload ID: 18034
  Gene Name: transglutaminase 1
  ENST ID: ENST00000559669
  CDS Start-End: 1-387
tacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttgggtgagtctggcctctccccctacccctgc

SEQ ID NO: 192679 - DNA, 555 bp, Homo sapiens
  Payload ID: 18034
  Gene Name: transglutaminase 1
  ENST ID: ENST00000558074
  CDS Start-End: 151-555
agaactcggcagcaggagcctgtgagagcagagtcacttaccaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgag

SEQ ID NO: 192680 - DNA, 580 bp, Homo sapiens
  Payload ID: 18034
  Gene Name: transglutaminase 1
  ENST ID: ENST00000560226
  CDS Start-End: 455-580
acagaactcggcagcaggagcctgtgagagcagaggtaggcagcctaagcttgggaccagaaggtcggccagacagggctgtgggtggaagggcctgcctgccccactgcccttgcagcttcttcatccgggagaaggggctcctcacatgcccagtctggtaggaatcagcctggtgccaggggccatcacagcggtggctcccaccaaagcccagcctaagcccccagacctcacccctgctccctccctagcatcttctccccatttcccgcccagaggcctggcctcttctctccgccccctacagcagtttggcccctccctcccacataagtcacttaccaggtctgtccctgcggcatccagtctgtgggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttcc

SEQ ID NO: 192681 - DNA, 5070 bp, Homo sapiens
  Payload ID: 18035
  Gene Name: transglutaminase 2
  Uniprot ID: P21980
  ENST ID: ENST00000361475
  CDS Start-End: 175-2238
actgggcaatgggtggcctcccaggtcgccgccttcccgcggggccccgcccccggcccgccccaaagcgggctataagttagcgccgctctccgcctcggcagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaactaggtctggtctgttcctttatgagtttggagggagatgggtaggtgagctcgctcacacctggacccccacttcctgcctaggagtctttcctgagcctcagccctgtccctgcgtttaaactttactggcattcaaggtcctacacaggctggctccatctccggccccttccaccaacagtctgtttttgggccacaattaacttcctgtatccccagaacaccctgcgtagttgtctacctcttggcttttgtgtatgtagttccctgagcctggagtgcccctccttttctttccctgcttggcaaactcctactcatcctataatgcttaacaccaaagtcacctcttctgtgaaaccttccttgatatcttttcgggtccccagagtcctggaatatggaccaattcaaacatttatcacagtaaattttacttccacgttggcctatctgtccccttctccatcctatctgaagccctcgaggcagggaccacgtatctcttaaatacactaataaatgctgaattggtaaatgaatgtttcctaactcaactcccacaagacctgtgctgtcccatagaaataatacatgagccacaaatgcaagccacatatgtaatttagaattttctagtgaccacattgaaaacagtaaaaaagccataggtggaattagctttaataatgtattttatttaatccaatatatccaaaacattatttcaacatgtaatcaatataagaattagtaaggtatttgaccttcttatttttgtactcaatctttgaaatgtggtgtgtgttttatactgacagcaggtctcaatttgaactagctgcatttcaagtgctcggtagccagtctggctagtactggatgaagcaggtctagactgcgattccgtggatgtgcagacttggtcattcatctcattccccaccatcgaagcactcatgagtatctgttgaatgaatagatgatggggacagtccccacccttgggaagtcatgtagaaagacatgacatgcacataaaaaataaatcaaaataaaaacatgacatca

SEQ ID NO: 192682 - DNA, 1018 bp, Homo sapiens
  Payload ID: 18035
  Gene Name: transglutaminase 2
  ENST ID: ENST00000373403
  CDS Start-End: 177-1018
acagtggatccggaagcacaggagaccaagagaccagagataccaggatgagagataggacccctggttgccaggttcgagaagtcctaggctgagtccctggaaatgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgc

SEQ ID NO: 192683 - DNA, 693 bp, Homo sapiens
  Payload ID: 18035
  Gene Name: transglutaminase 2
  ENST ID: ENST00000453095
  CDS Start-End: 215-693
gttttggaaaaagtgccagggaagccccgtgggcctctgtctctccgggaacccttcccgctcagggctcacagtggatccggaagcacaggagaccaagagaccagagataccaggatgagagataggacccctggttgccagtgccagccgccagtggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgt

SEQ ID NO: 192684 - DNA, 2642 bp, Homo sapiens
  Payload ID: 18036
  Gene Name: transglutaminase 3
  Uniprot ID: Q08188
  ENST ID: ENST00000381458
  CDS Start-End: 64-2145
gtctgtcagcactgtccgtgccattcccagaggagcctgagaagaggcagaggaaggcgaaacatggctgctctaggagtccagagtatcaactggcagacggccttcaaccgacaagcgcatcacacagacaagttctccagccaggagctcatcttgcggagaggccaaaacttccaggtcttaatgatcatgaacaaaggccttggctctaacgaaagactggagttcattgtctccacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatgtggatagcgtctttatgggtaaccacgctgagagagaagagtatgttcaggaagatgccggcatcatctttgtgggaagcacaaaccgaattggcatgattggctggaactttggacagtttgaagaagacattctcagcatctgcctctcaatcttggataggagtctgaatttccgccgtgacgctgctactgatgtggccagcagaaatgaccccaaatacgttggccgggtgctgagtgccatgatcaatagcaatgatgacaatggtgtgcttgctgggaattggagcggcacttacaccggtggccgggacccaaggagctggaacggcagcgtggagatcctcaaaaattggaaaaaatctggcttcagcccagtccgatatggccagtgctgggtctttgctgggaccctcaacacagcgctgcggtctttggggattccttcccgggtgatcaccaacttcaactcagctcatgacacagaccgaaatctcagtgtggatgtgtactacgaccccatgggaaaccccctggacaagggtagtgatagcgtatggaatttccatgtctggaatgaaggctggtttgtgaggtctgacctgggcccctcgtacggtggatggcaggtgttggatgctaccccgcaggaaagaagccaaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaagaggcagaacatcccataaagatctcgtacgctcagtatgagaagtacctgaagtcagacaacatgatccggatcacagcggtgtgcaaggtcccagatgagtctgaggtggtggtggagcgggacatcatcctggacaaccccaccttgaccctggaggtgctgaacgaggctcgtgtgcggaagcctgtgaacgtgcagatgctcttctccaatccactggatgagccggtgagggactgcgtgctgatggtggagggaagcggcctgctgttgggtaacctgaagatcgacgtgccgaccctagggcccaaggaggggtcccgggtccgttttgatatcctgccctcccggagtggcaccaagcaactgctcgccgacttctcctgcaacaagttccctgcaatcaaggccatgttgtccatcgatgtagccgaatgaagggcgctggtggcctcccgtacaaacttggacaacacggagcagggagagctcaccatggaatgaaccccccgcccatgctgtccggcctgggaaaccctctccatctcccaaggctgccagacatggacctccaggctccagcacatccccctctcctctcccccaggttggggctgggtccaccctgtcctatgacttgatcacttttgcacattccctggccgcttctccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagtcacctgccccagcactcacaccctaactcaaaataaatgttaaataagtgcgatcacac

SEQ ID NO: 192685 - DNA, 3388 bp, Homo sapiens
  Payload ID: 18037
  Gene Name: transglutaminase 4
  Uniprot ID: P49221
  ENST ID: ENST00000296125
  CDS Start-End: 69-2123
gactgtgtggaagcaccaggcatcagagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacagggccgaatcctagcatcgccaaacacaccctggtggtgctcgacccgaggacgccctcagaccactacaactggcaggcaacccttcaaaatgagtctggcaaagaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactggggactacgaaggtggcacagccccatacaagtggacaggcagtgccccgatcctgcagcagtactacaacacgaagcaggctgtgtgctttggccagtgctgggtgtttgctgggatcctgactacagtgctgagagcgttgggcatcccagcacgcagtgtgacaggcttcgattcagctcacgacacagaaaggaacctcacggtggacacctatgtgaatgagaatggcgagaaaatcaccagtatgacccacgactctgtctggaatttccatgtgtggacggatgcctggatgaagcgaccggatctgcccaagggctacgacggctggcaggctgtggacgcaacgccgcaggagcgaagccagggtgtcttctgctgtgggccatcaccactgaccgccatccgcaaaggtgacatctttattgtctatgacaccagattcgtcttctcagaagtgaatggtgacaggctcatctggttggtgaagatggtgaatgggcaggaggagttacacgtaatttcaatggagaccacaagcatcgggaaaaacatcagcaccaaggcagtgggccaagacaggcggagagatatcacctatgagtacaagtatccagaaggctcctctgaggagaggcaggtcatggatcatgccttcctccttctcagttctgagagggagcacagacgacctgtaaaagagaactttcttcacatgtcggtacaatcagatgatgtgctgctgggaaactctgttaatttcaccgtgattcttaaaaggaagaccgctgccctacagaatgtcaacatcttgggctcctttgaactacagttgtacactggcaagaagatggcaaaactgtgtgacctcaataagacctcgcagatccaaggtcaagtatcagaagtgactctgaccttggactccaagacctacatcaacagcctggctatattagatgatgagccagttatcagaggtttcatcattgcggaaattgtggagtctaaggaaatcatggcctctgaagtattcacgtctttccagtaccctgagttctctatagagttgcctaacacaggcagaattggccagctacttgtctgcaattgtatcttcaagaataccctggccatccctttgactgacgtcaagttctctttggaaagcctgggcatctcctcactacagacctctgaccatgggacggtgcagcctggtgagaccatccaatcccaaataaaatgcaccccaataaaaactggacccaagaaatttatcgtcaagttaagttccaaacaagtgaaagagattaatgctcagaagattgttctcatcaccaagtagccttgtctgatgctgtggagccttagttgagatttcagcatttcctaccttgtgcttagctttcagattatggatgattaaatttgatgacttatatgagggcagattcaagagccagcaggtcaaaaaggccaacacaaccataagcagccagacccacaaggccaggtcctgtgctatcacagggtcacctcttttacagttagaaacaccagccgaggccacagaatcccatccctttcctgagtcatggcctcaaaaatcagggccaccattgtctcaattcaaatccatagatttcgaagccacagagtctctccctggagcagcagactatgggcagcccagtgctgccacctgctgacgacccttgagaagctgccatatcttcaggccatgggttcaccagccctgaaggcacctgtcaactggagtgctctctcagcactgggatgggcctgatagaagtgcattctcctcctattgcctccattctcctctctctatccctgaaatccaggaagtccctctcctggtgctccaagcagtttgaagcccaatctgcaaggacatttctcaagggccatgtggttttgcagacaaccctgtcctcaggcctgaactcaccatagagacccatgtcagcaaacggtgaccagcaaatcctcttcccttattctaaagctgccccttgggagactccagggagaaggcattgcttcctccctggtgtgaactctttctttggtattccatccactatcctggcaactcaaggctgcttctgttaactgaagcctgctccttcttgttctgccctccagagatttgctcaaatgatcaataagctttaaattaaactctacttcaagaaaactctgtggtccctgagtccttttttctttatgccaataagcttcttaaatgtgctggcggtttatgcagtcacttggggagccatggaatcctttgatctccccaggcaaggtgctctgaggagttggcttctttattgtctgttcagtacatccaacccctctctcaaaggctgtcaccccaactggatacacaccctggcaaaggcacgtagcttgaatgagggttattttgtgtctaattcacaggagagtcatgggtgggatacctgtcatcctctgcctttccagctgtccaagtgaaaaaaacctcaatcctggtcacccttgcccaagttgcccacatccctggcatacagtaggtgttcaataaatgtttattgaaggaaa

SEQ ID NO: 192686 - DNA, 641 bp, Homo sapiens
  Payload ID: 18037
  Gene Name: transglutaminase 4
  ENST ID: ENST00000422219
  CDS Start-End: 45-320
agagatagagtcttccctggcattgcaggagagaatctgaagggatgatggatgcatcaaaagagctgcaagttctccacattgacttcttgaatcaggacaacgccgtttctcaccacacatgggagttccaaacgagcagtcctgtgttccggcgaggacaggtgtttcacctgcggctggtgctgaaccagcccctacaatcctaccaccaactgaaactggaattcagcacaggtcacagtggctgtcaccagttcccccaatgccatcctgggcaagtaccaactaaacgtgaaaactggaaaccacatccttaagtctgaagaaaacatcctataccttctcttcaacccatggtgtaaagaggacatggttttcatgcctgatgaggacgagcgcaaagagtacatcctcaatgacacgggctgccattacgtgggggctgccagaagtatcaaatgcaaaccctggaactttggtcagtttgagaaaaatgtcctggactgctgcatttccctgctgactgagagctccctcaagcccacagataggagggaccccgtgctggtgtgcagggccatgtgtgctatgatgagctttgagaaaggccagggcgtgctcattgggaattggactgg

SEQ ID NO: 192687 - DNA, 3388 bp, Homo sapiens; identical to SEQ ID NO: 192685
  Payload ID: 18037
  Gene Name: Transglutaminase 4
  ENST ID: ENST00000628744
  CDS Start-End: 69-2123

SEQ ID NO: 192688 - DNA, 641 bp, Homo sapiens; identical to SEQ ID NO: 192686
  Payload ID: 18037
  Gene Name: Transglutaminase 4
  ENST ID: ENST00000627547
  CDS Start-End: 45-320

SEQ ID NO: 192689 - DNA, 1958 bp, Homo sapiens
  Payload ID: 18038
  Gene Name: transglutaminase 5
  Uniprot ID: O43548
  ENST ID: ENST00000349114
  CDS Start-End: 9-1925
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 192690 - DNA, 2767 bp, Homo sapiens
  Payload ID: 18038
  Gene Name: transglutaminase 5
  Uniprot ID: O43548
  ENST ID: ENST00000220420
  CDS Start-End: 9-2171
cagctaccatggcccaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctc

SEQ ID NO: 192691 - DNA, 2202 bp, Homo sapiens
  Payload ID: 18038
  Gene Name: transglutaminase 5
  ENST ID: ENST00000622115
  CDS Start-End: 4-2169
accctggctgccccagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 192692 - DNA, 2756 bp, Homo sapiens
  Payload ID: 18038
  Gene Name: transglutaminase 5
  ENST ID: ENST00000610827
  CDS Start-End: 1-2160
gctcaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctc

SEQ ID NO: 192693 - DNA, 2510 bp, Homo sapiens
  Payload ID: 18038
  Gene Name: transglutaminase 5
  ENST ID: ENST00000611276
  CDS Start-End: 1-1914
gctcaagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttcaagcttcaggaaaaggagcaagttcaaatgcaagctgcgccattccccaccacaacagaggcttcacagggctccagcaagagccacagaggggatgacgtgttcattttctgtctctcctgactccactagaaatttaagctccatgagggcaaagactttgctttgtttactacccctatactcagaaccatttctggcatatgctaggcactcaacaaatattttttgaatgaatgaataggagactccagcatccagagaacaggtaggaaatgtctatggatggatatttccctggaccatttgcacagctcccctggactcttttcagggcccagggattccactgtgtcccatccagagattccaggattccagtctcctatccagaagcgtgatttggcacagaggtcagaggatactggtaggacttggccatgacttaactgccccctgccccagatatccaggaaagaaaaagacaggctgaacagctcactgttgttttgttgttgcgaaagctaattccctagtatgaataaacttcagaccttgctctc

SEQ ID NO: 192694 - DNA, 2292 bp, Homo sapiens
  Payload ID: 18039
  Gene Name: transglutaminase 6
  Uniprot ID: O95932
  ENST ID: ENST00000202625
  CDS Start-End: 62-2182
actgtcctgacggtgcacacactgctgtgtggaggaacagaggagtccagctggccttcacatggcagggatcagagtcaccaaggtggactggcagcggtcgaggaatggcgctgcccaccacacccaggagtacccctgccctgagctggtggttcgcaggggccagtcgttcagcctcacgctggagctgagcagagccctggactgtgaggagatcctcatcttcacgatggagacaggaccccgggcttctgaggccctccacaccaaagctgtgttccagacatcggagctggagcggggtgagggctggacagcagcaagggaggctcagatggagaaaactctgaccgtcagtctcgccagccctcccagtgctgtcattggccgctacctgctgagcatcaggctttcctctcaccgcaaacacagcaaccggaggctgggcgagtttgttctccttttcaacccatggtgtgcagaggacgatgtgtttctggcctcagaggaggagagacaggagtacgtgctcagcgacagcggcatcatcttccgaggcgtggagaagcacatacgagcccagggctggaactacgggcagtttgaggaggacatcctgaacatctgcctctccatcctggatcgaagccccggtcaccaaaacaacccagccaccgacgtgtcctgccgccacaaccccatctacgtcaccagggtcatcagtgccatggtgaacagcaacaacgaccgaggtgtggtgcaaggacagtggcagggcaagtacggcggcggcaccagcccgctgcactggcgcggcagcgtggccattctgcagaagtggctcaagggcaggtacaagccagtcaagtacggccagtgctgggtcttcgccggagtcctgtgcacagtcctcaggtgcttggggatagccacacgggtcgtgtccaacttcaactcagcccacgacacagaccagaacctgagtgtggacaaatacgtggactccttcgggcggaccctggaggacctgacagaagacagcatgtggaatttccatgtctggaatgagagctggtttgcccggcaggacctaggcccctcttacaatggctggcaggttctggatgccaccccccaggaggagagtgaaggtgtgttccggtgcggcccagcctcagtcaccgccatccgcgagggtgatgtgcacctggctcacgatggccccttcgtgtttgcggaggtcaacgccgactacatcacctggctgtggcacgaggatgagagccgggagcgtgtatactcaaacacgaagaagattgggagatgcatcagcaccaaggcggtgggcagtgactcccgcgtggacatcactgacctctacaagtatccggaagggtcccggaaagagaggcaggtgtacagcaaggcggtgaacaggctgttcggcgtggaagcctctggaaggagaatctggatccgcagggctgggggtcgctgtctctggcgtgacgacctcctggagcctgccaccaagcccagcatcgctggcaagttcaaggtgctagagcctcccatgctgggccacgacctgagactggccctgtgcttggccaacctcacctcccgggcccagcgggtgagggtcaacctgagcggtgccaccatcctctatacccgcaagccagtggcagagatcctgcatgaatcccacgccgtgaggctggggccgcaagaagagaagagaatcccaattacaatatcttactctaagtataaagaagacctgacagaggacaagaagatcctgttggctgccatgtgccttgtcaccaaaggagagaagcttctggtggagaaggacattactctagaggacttcatcaccatcaaggttctgggcccagccatggtgggagtggcagttacagtggaagtgacagtagtcaaccccctcatagagagagtgaaggactgtgcgctgatggtggagggcagcggccttctccaggaacagctcagcatcgacgtgcctaccctggagcctcaggagagggcctcagtccagtttgacatcaccccctccaaaagtggcccaaggcagctgcaggtggaccttgtaagccctcacttcccggacatcaagggctttgtgatcgtccatgtggccactgccaagtgatggatcatgagggactgagaggggtggatttggcccctgtcctcctcctgcccattctttgtctcttccacatgggagccaggaggcctcagttaatcctgcctcaacct

SEQ ID NO: 192695 - DNA, 2158 bp, Homo sapiens
  Payload ID: 18039
  Gene Name: transglutaminase 6
  Uniprot ID: O95932
  ENST ID: ENST00000381423
  CDS Start-End: 62-1939
actgtcctgacggtgcacacactgctgtgtggaggaacagaggagtccagctggccttcacatggcagggatcagagtcaccaaggtggactggcagcggtcgaggaatggcgctgcccaccacacccaggagtacccctgccctgagctggtggttcgcaggggccagtcgttcagcctcacgctggagctgagcagagccctggactgtgaggagatcctcatcttcacgatggagacaggaccccgggcttctgaggccctccacaccaaagctgtgttccagacatcggagctggagcggggtgagggctggacagcagcaagggaggctcagatggagaaaactctgaccgtcagtctcgccagccctcccagtgctgtcattggccgctacctgctgagcatcaggctttcctctcaccgcaaacacagcaaccggaggctgggcgagtttgttctccttttcaacccatggtgtgcagaggacgatgtgtttctggcctcagaggaggagagacaggagtacgtgctcagcgacagcggcatcatcttccgaggcgtggagaagcacatacgagcccagggctggaactacgggcagtttgaggaggacatcctgaacatctgcctctccatcctggatcgaagccccggtcaccaaaacaacccagccaccgacgtgtcctgccgccacaaccccatctacgtcaccagggtcatcagtgccatggtgaacagcaacaacgaccgaggtgtggtgcaaggacagtggcagggcaagtacggcggcggcaccagcccgctgcactggcgcggcagcgtggccattctgcagaagtggctcaagggcaggtacaagccagtcaagtacggccagtgctgggtcttcgccggagtcctgtgcacagtcctcaggtgcttggggatagccacacgggtcgtgtccaacttcaactcagcccacgacacagaccagaacctgagtgtggacaaatacgtggactccttcgggcggaccctggaggacctgacagaagacagcatgtggaatttccatgtctggaatgagagctggtttgcccggcaggacctaggcccctcttacaatggctggcaggttctggatgccaccccccaggaggagagtgaaggtgtgttccggtgcggcccagcctcagtcaccgccatccgcgagggtgatgtgcacctggctcacgatggccccttcgtgtttgcggaggtcaacgccgactacatcacctggctgtggcacgaggatgagagccgggagcgtgtatactcaaacacgaagaagattgggagatgcatcagcaccaaggcggtgggcagtgactcccgcgtggacatcactgacctctacaagtatccggaagggtcccggaaagagaggcaggtgtacagcaaggcggtgaacaggctgttcggcgtggaagcctctggaaggagaatctggatccgcagggctgggggtcgctgtctctggcgtgacgacctcctggagcctgccaccaagcccagcatcgctggcaagttcaaggtgctagagcctcccatgctgggccacgacctgagactggccctgtgcttggccaacctcacctcccgggcccagcgggtgagggtcaacctgagcggtgccaccatcctctatacccgcaagccagtggcagagatcctgcatgaatcccacgccgtgaggctggggccgcaagaagagaagagaatcccaattacaatatcttactctaagtataaagaagacctgacagaggacaagaagatcctgttggctgccatgtgccttgtcaccaaaggagagaagcttctggtggagaaggacattactctagaggacttcatcaccatcaagcgtgcctaccctggagcctcaggagagggcctcagtccagtttgacatcaccccctccaaaagtggcccaaggcagctgcaggtggaccttgtaagccctcacttcccggacatcaagggctttgtgatcgtccatgtggccactgccaagtgatggatcatgagggactgagaggggtggatttggcccctgtcctcctcctgcccattctttgtctcttccacatgggagccaggaggcctcagttaatcctgcctcaacct

SEQ ID NO: 192696 - DNA, 2313 bp, Homo sapiens
  Payload ID: 18040
  Gene Name: transglutaminase 7
  Uniprot ID: Q96PF1
  ENST ID: ENST00000452443
  CDS Start-End: 6-2138
gggagatggatcaggtggcaaccttgcggcttgagtctgtcgacctgcagagctccaggaacaacaaggagcaccacacgcaggagatgggcgtcaagcggctcactgtgcgccgcggccagcccttctacctccggctgagcttcagccgacccttccagtcccagaacgaccacatcacctttgtggctgagaccggacccaagccgtcagagctgctggggacccgagccacattcttcctcacccgggtccagcccgggaatgtctggagcgcttctgatttcaccattgactccaactctctccaagtttcccttttcacaccagccaatgcagttattggccattacactctgaaaatagagatctctcagggccaaggtcacagtgtgacttacccgctgggaactttcatcctactttttaacccttggagtccagaggacgacgtctacctgccaagtgaaatactgctgcaggagtatatcatgcgagattatggctttgtttacaagggtcatgaaagattcatcacctcctggccctggaactacgggcagtttgaagaggacatcatagacatctgctttgagatcctgaacaagagcctgtatcacttaaagaacccggccaaagactgttcccagcggaacgacgtggtgtatgtgtgcagggtggtgagtgccatgatcaacagcaacgatgacaatggcgtgctgcaggggaactggggcgaggactactccaaaggggtcagtcctctggagtggaagggcagtgtggccatcctacagcagtggtcagccaggggcgggcagcctgtgaagtacggacagtgctgggtcttcgcctctgttatgtgcaccgtaatgagatgcttaggtgttccaacccgtgttgtttccaatttccgttccgcgcacaacgtggataggaacttgaccatcgatacgtactatgaccgaaatgccgagatgctgtcaactcagaaacgagacaaaatatggaacttccacgtctggaatgagtgctggatgatccggaaagatctcccaccaggatacaacgggtggcaggttctggaccccactccccagcagaccagcagtgggctgttctgctgtggccctgcctctgtgaaggccatcagggaaggggatgtccacctggcctatgacaccccttttgtgtatgccgaggtgaacgccgatgaagtcatttggctccttggggatggccaggcccaggaaatcctggcccacaacaccagttccatcgggaaggagatcagcactaagatggtggggtcagaccagcgccagagcatcaccagctcctacaagtacccagaaggatcccctgaggagagagctgtcttcatgaaggcttctcggaaaatgctgggcccccaaagagcttctttgcccttcctggatctcctggagtctgggggtcttagggatcagccagcgcagctgcagcttcacctggccaggatacccgagtggggccaggacctgcagctgctgctgcgtatccagagggtgccagacagcacccaccctcgggggcccatcggactggtggtgcgcttctgtgcacaggccctgctgcatgggggtggtacccagaagcccttctggaggcacacagtgcggatgaacctggactttgggaaggagacacagtggccgctcctcctgccctacagcaattacagaaacaagctaacggacgaaaagctcatccgcgtgtctggcatcgcggaggttgaagagacagggaggtccatgctggtcctaaaagatatctgtctggagcctccccacttgtctattgaggtgtctgagagggctgaggtgggcaaggcgctgagagtccatgtcaccctcaccaacaccttaatggtggctctgagcagctgcacgatggtgctggaaggaagcggcctcatcaatgggcagatagcaaaggaccttgggactctggtggccggacacaccctccaaattcaactggacctctacccgaccaaagctggaccccgccagctccaggttctcatcagcagcaacgaggtcaaggagatcaaaggctacaaggacatcttcgtcactgtggctggggctccctgagacccgccctccagctgccctccctggcacccctgccccacctggctcctttctactcctggctatgtcgtcttggctccacctctgtcctctctctagcctgcctgggaatgaatgaagctctgttagaaacaccgtgtgctttgggaagagacaataaagatgtctttattta

SEQ ID NO: 192697 - DNA, 6419 bp, Homo sapiens
  Payload ID: 18041
  Gene Name: trans-golgi network protein 2
  ENST ID: ENST00000282120
  CDS Start-End: 335-1774
acttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtatgtcttaattctgaatgttttccctgcacctcctaaaagatcttttttccccgtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatggattt

SEQ ID NO: 192698 - DNA, 6489 bp, Homo sapiens
  Payload ID: 18041
  Gene Name: trans-golgi network protein 2
  Uniprot ID: O43493
  ENST ID: ENST00000377386
  CDS Start-End: 464-1777
ttcccacatgggagagaccagagcacagcacgtttgtgtacggccaggagggaaccacgaaaaaagcagaggatagaaacgcaagcacacgatggtggtggccaagaggagcctgcccctagtgacctcacttccgcggccagtgcgagaggcgagggagctccagctctgcctgtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaatgg

SEQ ID NO: 192699 - DNA, 6138 bp, Homo sapiens
  Payload ID: 18041
  Gene Name: trans-golgi network protein 2
  Uniprot ID: O43493
  ENST ID: ENST00000398263
  CDS Start-End: 290-1429
gtaaggtctcggaagtacgaggcggaggggacgaaaaacggggggccagactgttgtggctgtggtggagacgagaaaccaggaagaagaggctcgcctcccactcggcgacagtaagcgaagcagccgaaggcgagcgccgacatcagcagctgccccctaaatcccgcccttcgtcttggcggcagcgggagactgagagacgcgcgcagcaggggcgggactggagaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaatcatactcagtaggaactttttgaaatagggcaagtttatgtttcatgcgagaaaacatgaaggagggttttggttttggtctgcagtttttccaaagggcttttatgagatacatttcccacaaagtccattttgcctttgttgcctaaaacagacaaaatagacttagatttattaatagaaactatactctctgccaattttacctcagtgtatttaatggtcctttaatctgatataagatgccaagggtatttgataaaaattcttcttccatgccatgtcaggagttaatacaaatgaagaaattccgtgggttcccctgggataagtgagggtagtgtcttggacaacactattgtttgaaggtttatcttttctaatcatgctctaccgcattgtagagagcctaaagagagttgtttctgagctgatctcagggaaatacaaataacttgggagatgagggaaataagatgaattctgtgctgtcaaggcagtaagtctgaagaaaggaccatgcttcttatattatcttccaccttgcttaaaacagcccatagctttgagttgacattttcattcttggcggatagcctactttatgaaggtaaggaatgaactcctacccttcttgggtcattctctgtactgatgcgttagtcttataatactttgcaccaacctgaggaatcttctaggcttctctagcatcccctaagactgtggctatttcacgtctctctccctgcctgccttccttttcccttcctttcccctcctcatgttttctggttgtgcccatctgtaccagctcctttccatccaccttcgtatgcacccagatttttctgttcccatctgtcctatttgttattcatcccgctgctcaacttctccagtatgttgcttcccttaagttgccattcattctcttcatgacttttactaactcacttcggtctctgtctgtcaactaaacttttctaaaggttaccagttatccaatcaccaaatccatggctttttctcaaagcttagtcttgtccttggcagaactggacactattgaccatccaaatggaaattcccctttcttggtgtctctgacaaatggtcctttgccttatcttgtgctggtggtgaagaggccctcaaagccaggcctctctattcctttgactgtctcctcagccattaacccattcttcatcctcggagtgagtgattcccaagtctttgtcttggcttaatccctaaagaacccagttctgctggtatcgaatagttcagcttggttgtcattgaaaggaatttctctcttctgtccatcagcctgtccctcccaactgtctaggacagtcttcggtcacctaaattcctaactgcagacttttgccctttttctctctcatcaccaaagtcccatccatttttttttaataaaagatcctcagctacagtctttccattttccttgcttctcttattgcacacccccagcccattttgcttctctcttggattttgttttttcagatccacatttattgggtttcctgtccagcttcttggaaaggagctcactcttggaaagactgatctttccaaaatattttccctggtctgaagctttggtgtgaacttctcaaggcttagagaatccagttacagaccttttggggttcaggatgctatagattgacaccctcctgcctgtttttctctgcatcccaacctggccaaggcccctcctgtggggtgcccatctgtgcctttattccggctgtgccctcgactttccagcttcccatgtttctttggttaggtttctctcccttccttctttctccttccccaatccgcctgtttcgtcagggcccagtttgtttcctcatacaccttcctcactaccccaccccacatggttgactctttccctcagctccaccagctcttcatcatgccactcatttcagaacttgagcaaaacagggcagtcaggatctgatgtctttctggtctccctaagaaaactaagctcttgagggacagcccttggcaatgctttcctatctgctgatcatggtgaccttccttaggacttccagagttcagttccttctggcagagaggttttctttctccatgccatatggatgtgactcaaatgaggggtcccacagcttttcctggctaccacttgctgtgaccttatacatgttggggtttgctcttaaagaggagagcaggaagaaaggttggtttcagaaaccaagagggtcggcagtggacgcgtacattttgtcacggagtccacagagctgagcttttgagcagactctgagaagtatcattgcttgtgttgaaagaatacaacaggatttaagtttctctttagaaattgcactgaagaaaggccgggcgcggtggctccccctgtaatcccagcgctttgggaggccgaggcggggggatcacgaggtcaagagatcgagaccatcctggccaacatggtgaaaccccgtctctaataaaaatacaaaaattagccgggcatggtgacgtgcacctgtagtcccagctactagataggctgaggcaggagaattgcttgaatccgggaggcggaggttgcagtgagccgagatcgtgccactgaactccaacctgccaatagagcgagactccgtctcaaaaaaaaaaaaaaaaaagaaagaaatagcattgaagaaaataccgcacatcagaggaaagcttattttctgcatggtgtcttttcaaagatagaatatttgaagcatgttttctagcgattgtgtggatgagggtgagctggctgaggcatcgctcaagctggggggtggtgtgtaagaagcacgtggagccacaagaggcacctcctatagtcagctaagggcttccctttctgcgcccagcttttgggtgaagggtgatttctattagacacatctgtgcttcagtcatagatgttaatagaggaagcagttttcctgctgcagattcctgaatagagttgctgaaagagtctacttctggactcaggggaagttgaaggccagtctgtgtagaaaggctgaggcaacggggaaagacctgacagctagttacatacgctctgacatagtactcccatgatggcttccagtgacacatgtgctgatagaattctaaacctctggaatttccctgctggcgacttctatggccgttgactgtacagggtaacctgatgccagatgctatgggcgtgatgagaactagagcattgcagcatggaggaaactgtgaggcaccagatcctgtgcttctgcaggccattttctgaaaacccctgttaggaaggttggatttggcgtgacttgcttgagcaagagtcctggggagagattttgaggtttaatttaacggtatatccagagctaacagtgactcaactcgtctagttctgcaagtcagatgtacacttagagtctctctgtgaagggtttgggtctgagctgtatagtatgtcaaactgccagtaagccagcccctcaccctctgatagatattcctttaatgcaccagacttcatgtttgataaatgattaatggttgaaattgtttctcttcttttgtgttttcccagttaatagatggtcactgtttccacaatgttttatactttcagctttttgtaacttaactataattacttaattttatttttttaaagcttgttgtggtctaatgagaagtatttttcagtgcataatgtttttctgagcttctgtaaatgccatcccaatgtggtttggttttgttgaacagaaaccaaaataaatttcaaaatgttaaagcaa

SEQ ID NO: 192700 - DNA, 2235 bp, Homo sapiens
  Payload ID: 18041
  Gene Name: trans-golgi network protein 2
  Uniprot ID: O43493
  ENST ID: ENST00000409232
  CDS Start-End: 63-1424
agaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaa

SEQ ID NO: 192701 - DNA, 2276 bp, Homo sapiens
  Payload ID: 18041
  Gene Name: trans-golgi network protein 2
  ENST ID: ENST00000409015
  CDS Start-End: 63-1427
agaggggccccgcgcgcggatctcgcgagagcattagagggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaagtatgtcttaattctgaatgttttccctgcacctcctaaaagatcttttttcccctaagtcctaacagaatggtatattcctctggaaaaagatgaacgtcaccaatggattgtgctgctctcgtttcagctttgatttttttgtccttgagaaccttgtcctccctgctgatttgtttctaaatcaaaagaaatgaagaaaaaagtactgtgacctgagagacaccctcctctagaatttagtggcgggtctgggctggcagaggtagggggctgctttgggctttgcacctgcactttggtgacattgttcttctgtgttccctttatttatgctggtggcttccatccgttcctcctctgagggtgagtggaggggtatatggaaacacggctatgaccaaagggagatcccagcctgggcaggctgcgctgctgaccaccctccctggggcccgggctctgtaggaaagttggtccttgactgtggcattgcactctgcactgtttctctctgcagacctaggggaaaactgcaggtggaagtgcttttctactaaggcctcttactttgggggggatgtgccctacagaagacatagaagatggggaaatgccaatgggcaaagagctactttgaatacataattctcttcaaagacttcagcagcaaaccaaaacagcaggttaaaaaaaaagatgcttttttgggtgcaagtctaacctgtctagcatgagatcttcttgattttctgattattttatgtagcttgagacaaagtgaatcaacttccacttagttgtaccgagcataaaacagaacttgggcttcctggcagtgaggccactgtcccatcacagatttttaaaataaatatgatttgaagtagtgtgatctttcacacaa

SEQ ID NO: 192702 - DNA, 1861 bp, Homo sapiens
  Payload ID: 18041
  Gene Name: trans-golgi network protein 2
  Uniprot ID: O43493
  ENST ID: ENST00000444342
  CDS Start-End: 24-1367
ggcggaagcgctatccgagcaggatgcggttcgtggttgccttggtcctcctgaacgtcgcagcggcgggagccgtgccgctcttggccaccgaaagcgtcaagcaagaagaagctggagtacggccttctgcaggaaacgtctccacccaccccagcttgagccaacggcctggaggctctaccaagtcgcatccggagccgcagactccaaaagacagccctagcaagtcgagtgcggaggcgcagaccccagaagacacccccaacaagtcgggtgcggaggcaaagacccaaaaagacagctccaacaagtcgggtgcggaggcaaagacccaaaaaggcagcactagcaagtcgggttcggaggcgcagaccacaaaagacagcactagtaagtcgcatccggagctgcagactccaaaagacagcactggcaaatcgggtgcggaggcgcagaccccagaagacagccccaacaggtcgggtgcggaggcaaagacccaaaaagacagccctagcaagtcaggttcggaggcgcagaccacaaaagatgtccctaataagtcgggtgcggacggccagaccccaaaagacggctccagcaagtcgggtgcggaggatcagaccccaaaagacgtccctaacaagtcgggtgcggagaagcagactccaaaagacggctctaacaagtccggtgcagaggagcagggcccaatagacgggcccagcaagtcgggtgcggaggagcagacctcaaaagacagccctaacaaggtggttccagagcagccttcccggaaagaccattccaagcccatctccaacccttctgataacaaggagctccccaaggctgacacaaaccagcttgctgacaaagggaagctttctcctcatgctttcaaaaccgaatctggggaggaaactgacctcatttctcccccgcaggaggaagttaagtcttcagagcctactgaggatgtggagcccaaagaggctgaagatgatgatacaggacccgaggagggctcaccgcccaaagaagagaaagaaaagatgtccggttctgcctccagtgagaaccgtgaagggacactttcggattccacgggtagcgagaaggatgacctttatccgaacggttctggaaatggcagcgcggagagcagccacttctttgcatatctggtgactgcagccattcttgtggctgtcctctatatcgctcatcacaacaagcggaagatcattgcttttgtcctggaaggaaaaagatctaaagtcacccggcggccaaaggccagtgactaccaacgtttggaccagaaggtaaggaaggaggagccaggtccatgggagggataggagggataggcaacgtcagatggacccagtagtgggcttgcatttgccatgaagcagcagtggctgattctggggatgcggttgctgttgctgttgcattcgccctttttagacaacaaactagaaacatctagatacacatatctgtgacgttagagctagcagagaccttggaatactctacagcagctacctcccttcacagatgaggaaataggcccacgcagaaacactcttttttttttttttccgctaagtttctactgcaagttagtggcaaactcaggacctgatagcaactccctagtctcccagtcctgagctttctgcattctgccagcgctccataaactttaataggcatttgaatcaccttggggaattttgataaaaagcattatctgattcattagatgtggggtggagcctatatttctacattcttttttttttttttggagatggagttttgctcttgttgcccaggctggagt

SEQ ID NO: 192703 - DNA, 3360 bp, Homo sapiens
  Payload ID: 18042
  Gene Name: trans-golgi network vesicle protein 23 homolog A (S. cerevisiae)
  Uniprot ID: A6NH52
  ENST ID: ENST00000299866
  CDS Start-End: 293-934
actatctctgtccgcagttccccaggccgttgcctccctgccgccgctttctctcctgggcgcgtccccggcgagccgagccccctccccagcctgcgactgcgccttaggccccgagcgccccgccccacccgagaagctgcgctgaggctgccccacagggcgcaggccccgaccctcagcgtccaccgtctgctgcctacatccgcccgcccggcgtccgaccccttcagcggcgacgggcggagctggagccccgggcctgggcgccaggtgggctcctgggagggtgatgaagcaggccctggtggacgataccgaggatgtgtccctggactttggaaacgaggaggagctggcctttaggaaagccaagatcagacaccccttggccacctttttccacctgtttttccgagtgagtgccatcgtcacctacgtgagctgcgactggttcagcaagagctttgtgggctgttttgtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattaggaactgatgaggttctcttcttttgactgatggagattacaaaactcttggattcctggaaaacaagacgacaggcatagagtgctaatggcttgtctaccccttgacagccctgtcctgtgctggggagggctgtgttttgacaggggtggaatcctctggctagttccataaaaagacctgtgtctgtgatgccctgagtctttgaaagtgaccggaatacctcacactacccatcttgctcataaccagtggctgcggccttcctcggaccatctatagatggaggattctgggaatgctgtttccttacccttgacatcattcttctaggcaagtaaaacccagccacaaactcagagaccacagctttaacaaacactgacacctctgccctaactctggggcctctgatggctgccactggctgaatgtggcctgcacgtgggtttggtctggctcaacaaagtttttatttttattttttatttttttgagacacggtctcacgctgttgcccaggctggagtgcagtggcgcgatctcgccttactgcagcctccgcctcccaggttcaagcgattctcctgcctcagcctcctgagtagctgggactacaggcatgcgccaccacacccggctaattttcatatttttagtagagacagtgtttctccatgttagccaggctggtcttgaactcctgaccagcctcaagtgatctgcctgcctccttcacccaaagtgctgggattccaggtgtgagccactgcacctggccttttttttttttatcagttacttttaaaaatgaattactttatccctttattgggatgtatttcctaagccataaatttcaccctcaccatgttttttaaactatgaattaattcacaatactcacacattgagagatttctcatggactcctggcttcctcggctatgggggccactctgtggtcatcacagaccccaccacccacctgtccttccacacccctggctcctttatgttgcttcctgccccacaggcatctgcatttagtactcatggaaatacttactctgaattatacttctgtaggctaacgtggctggggaatctggggcgtcaatgaaaaaagactggcctttgtcacaattcttaccttaaaaaagaaacaaacggaagacaattcagtccaagaggaaaacagaatggccacaagatcttggggctctttccgtgctggtgacaatgggaagatcttgagcccgcttcactcgtaatgaagaacaaagtagaaaagaccagtggggtctcagggaccttccttccagcagggtccccagccagcatttcagcgtggctaaataatcaggtggtgtacagaaaatgcaggttccagggccctacagagaactgattcagcagcttccacatgggcccaggagtctgcattttaagagattagcttttgagtgaaaggatcatgaatgcacatggttaaaaaaagtacagaatgcaaaaggatatggcataaaaggccaagtccgaaaagggctactagtgttctaggtgtctttccagaaagattatgcgcatataaatgtgcacacttgcatgtgtgcgcacacacatacacacactctcatatacctaaaatacgaatgggagcacatgacacacacattctgcctgctgctttgtctgtgtataattttatcttccaggtcatctgtgctggtgtctatcagtctgctagtctttccccgccatgtggccattgttccagtcccctcctatgcacacccaggtttctctaggaccatgttatcccagagccaggtggacaggacacaaggggctaggggtcaatgggggtgttctcgcctccagtctgccctgccagcccccagtcgtgggtggacctgccatcagcttgctctgcccactccccaggcctgagctgctggcgaaacaggcaagtgactgcactgcccatggccggtcaccagcctcaggtgaaccccaggaggggttcctacctagcactcatcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcgtacctcaagtagagggtatttaaacacaaaaactctgtaatggggcctttgagcccctattctcaggcccgttctcctcccacaccgtggagttgactttcattttcaataaatcccttccttccttccttt

SEQ ID NO: 192704 - DNA, 1223 bp, Homo sapiens
  Payload ID: 18042
  Gene Name: trans-golgi network vesicle protein 23 homolog A (S. cerevisiae)
  Uniprot ID: A6NH52
  ENST ID: ENST00000456096
  CDS Start-End: 108-674
ccaccgtctgctgcctacatccgcccgcccggcgtccgaccccttcagcggcgacgggcggagctggagccccgggcctgggcgccaggtgggctcctgggagggtgatgaagcaggccctggtggacgataccgaggatgtgtccctggactttggaaacgaggaggagctggcctttaggaaagccaagatcagagaccgggtctcaaaactcctagcctcagtgatcctcctgccttggcctcccaaagtgctgggattaaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattagatgtttcccctgacaaacgtcctgcccaccaatcccatctcggcagagctgaactgtggcagaggtgcaggctggcaggaatggatgtgccctgggctgctgcaagctcctgtccccaatcacatccattcatgcagcccaactgcctccaggggcctcagagggcagctctcatcaccacttccggccactgcaaaagctgcctgggaaagcagaaatagtttgcagagcagccttccgatcgtttcctcatccatgagagcaagatcttgctcgcctggcagccccacgcgccctcaccttgcacttaggacagatgaagccactcatgttctccaccaccccgatgatgggcagcttcaccttgcggcagaagttgatttctttccggacatcctggagtgacacctcctacgaaggtgaaaagaccagtgattccagcatcaaagtgcgagaaagggaatgtctgtgcaaccgaggggatggctgcaatgcagtggatctgcgatcataaagccttagaggtttctgccctgatagggtttggct

SEQ ID NO: 192705 - DNA, 3677 bp, Homo sapiens
  Payload ID: 18042
  Gene Name: trans-golgi network vesicle protein 23 homolog A (S. cerevisiae)
  ENST ID: ENST00000573360
  CDS Start-End: 159-272
agaagctgcgctgaggctgccccacagggcgcaggccccgaccctcagcgtccaccgtctgctgcctacatccgcccgcccggcgtccgaccccttcagcggcgacgggcggagctggagccccgggcctgggcgccaggtgggctcctgggagggtgatgaagcaggccctggtggacgataccgaggatgtgtccctggactttggaaacgaggaggagctggcctttaggaaagccaagatcaggaacacgcattccccgatgacatgagacacctgccccgtgggctgcgtgtgagcttggagctcagtgactggtggtggaaaaacccaacctttacctttagggaactggccgtcatctctgctaggcgggaaggcagtgactgctgtcacgtttcacttcaaagatgaccgtgtttcgaagagggcaagtgatatttggagtcaagtggcgggaaagtactggattcttcgaaggggaggaaaaaaaacagtgtcagcatgactgtctggggactgctgacctaatgatgtgtccccagggctacagcctgagtttctgcgtcatatgcaccggggagaacattccattgagccacgctaacacccccagcaaagtctgaagtggtaaagggagttcagtgaccatccgcttagctcttggagtgagggcgccttctgggtcctttcctagacaccccttggccacctttttccacctgtttttccgagtgagtgccatcgtcacctacgtgagctgcgactggttcagcaagagctttgtgggctgttttgtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattaggaactgatgaggttctcttcttttgactgatggagattacaaaactcttggattcctggaaaacaagacgacaggcatagagtgctaatggcttgtctaccccttgacagccctgtcctgtgctggggagggctgtgttttgacaggggtggaatcctctggctagttccataaaaagacctgtgtctgtgatgccctgagtctttgaaagtgaccggaatacctcacactacccatcttgctcataaccagtggctgcggccttcctcggaccatctatagatggaggattctgggaatgctgtttccttacccttgacatcattcttctaggcaagtaaaacccagccacaaactcagagaccacagctttaacaaacactgacacctctgccctaactctggggcctctgatggctgccactggctgaatgtggcctgcacgtgggtttggtctggctcaacaaagtttttatttttattttttatttttttgagacacggtctcacgctgttgcccaggctggagtgcagtggcgcgatctcgccttactgcagcctccgcctcccaggttcaagcgattctcctgcctcagcctcctgagtagctgggactacaggcatgcgccaccacacccggctaattttcatatttttagtagagacagtgtttctccatgttagccaggctggtcttgaactcctgaccagcctcaagtgatctgcctgcctccttcacccaaagtgctgggattccaggtgtgagccactgcacctggccttttttttttttatcagttacttttaaaaatgaattactttatccctttattgggatgtatttcctaagccataaatttcaccctcaccatgttttttaaactatgaattaattcacaatactcacacattgagagatttctcatggactcctggcttcctcggctatgggggccactctgtggtcatcacagaccccaccacccacctgtccttccacacccctggctcctttatgttgcttcctgccccacaggcatctgcatttagtactcatggaaatacttactctgaattatacttctgtaggctaacgtggctggggaatctggggcgtcaatgaaaaaagactggcctttgtcacaattcttaccttaaaaaagaaacaaacggaagacaattcagtccaagaggaaaacagaatggccacaagatcttggggctctttccgtgctggtgacaatgggaagatcttgagcccgcttcactcgtaatgaagaacaaagtagaaaagaccagtggggtctcagggaccttccttccagcagggtccccagccagcatttcagcgtggctaaataatcaggtggtgtacagaaaatgcaggttccagggccctacagagaactgattcagcagcttccacatgggcccaggagtctgcattttaagagattagcttttgagtgaaaggatcatgaatgcacatggttaaaaaaagtacagaatgcaaaaggatatggcataaaaggccaagtccgaaaagggctactagtgttctaggtgtctttccagaaagattatgcgcatataaatgtgcacacttgcatgtgtgcgcacacacatacacacactctcatatacctaaaatacgaatgggagcacatgacacacacattctgcctgctgctttgtctgtgtataattttatcttccaggtcatctgtgctggtgtctatcagtctgctagtctttccccgccatgtggccattgttccagtcccctcctatgcacacccaggtttctctaggaccatgttatcccagagccaggtggacaggacacaaggggctaggggtcaatgggggtgttctcgcctccagtctgccctgccagcccccagtcgtgggtggacctgccatcagcttgctctgcccactccccaggcctgagctgctggcgaaacaggcaagtgactgcactgcccatggccggtcaccagcctcaggtgaaccccaggaggggttcctacctagcactcatcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcgtacctcaagtagagggtatttaaacacaaaaactctgtaatggggcctttgagcccctattctcaggcccgttctcctcccacaccgtggagttgactttcattttcaataaatcccttccttccttccttt

SEQ ID NO: 192706 - DNA, 1298 bp, Homo sapiens
  Payload ID: 18042
  Gene Name: trans-golgi network vesicle protein 23 homolog A (S. cerevisiae)
  Uniprot ID: A6NH52
  ENST ID: ENST00000575135
  CDS Start-End: 108-749
ccaccgtctgctgcctacatccgcccgcccggcgtccgaccccttcagcggcgacgggcggagctggagccccgggcctgggcgccaggtgggctcctgggagggtgatgaagcaggccctggtggacgataccgaggatgtgtccctggactttggaaacgaggaggagctggcctttaggaaagccaagatcagacaccccttggccacctttttccacctgtttttccgagtgagtgccatcgtcacctacgtgagctgcgactggttcagcaagagctttgtgggctgttttgtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattagatgtttcccctgacaaacgtcctgcccaccaatcccatctcggcagagctgaactgtggcagaggtgcaggctggcaggaatggatgtgccctgggctgctgcaagctcctgtccccaatcacatccattcatgcagcccaactgcctccaggggcctcagagggcagctctcatcaccacttccggccactgcaaaagctgcctgggaaagcagaaatagtttgcagagcagccttccgatcgtttcctcatccatgagagcaagatcttgctcgcctggcagccccacgcgccctcaccttgcacttaggacagatgaagccactcatgttctccaccaccccgatgatgggcagcttcaccttgcggcagaagttgatttctttccggacatcctggagtgacacctcctacgaaggtgaaaagaccagtgattccagcatcaaagtgcgagaaagggaatgtctgtgcaaccgaggggatggctgcaatgcagtggatctgcgatcataaagccttagaggtttctgccctgatagggtttggct

SEQ ID NO: 192707 - DNA, 3256 bp, Homo sapiens
  Payload ID: 18042
  Gene Name: trans-golgi network vesicle protein 23 homolog A (S. cerevisiae)
  ENST ID: ENST00000572428
  CDS Start-End: 1-453
gtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattaggctttcttatcttcacaggcagaaatggcttaaacgggagtttctacaatcgactaagcttccgacacagcagaatcccacgatcccacaacccatttgttttttacgtgaaacaggcctcgggggagagatttgagggggttttattcttaaaacggcacatttgtagagaatgccctttatatatgttctaaagaaaagtgtacaaatactcaatgattaaagtgtctctgagaaagtggcttcggaccacaccagcatctggtccttttgctgtgacccaccccatcccggagctggtcgggtctggctggatgtgctgcccagtgagtgcctcgctcggtaactgcttggtcctgaacattctctcgtttcaggaactgatgaggttctcttcttttgactgatggagattacaaaactcttggattcctggaaaacaagacgacaggcatagagtgctaatggcttgtctaccccttgacagccctgtcctgtgctggggagggctgtgttttgacaggggtggaatcctctggctagttccataaaaagacctgtgtctgtgatgccctgagtctttgaaagtgaccggaatacctcacactacccatcttgctcataaccagtggctgcggccttcctcggaccatctatagatggaggattctgggaatgctgtttccttacccttgacatcattcttctaggcaagtaaaacccagccacaaactcagagaccacagctttaacaaacactgacacctctgccctaactctggggcctctgatggctgccactggctgaatgtggcctgcacgtgggtttggtctggctcaacaaagtttttatttttattttttatttttttgagacacggtctcacgctgttgcccaggctggagtgcagtggcgcgatctcgccttactgcagcctccgcctcccaggttcaagcgattctcctgcctcagcctcctgagtagctgggactacaggcatgcgccaccacacccggctaattttcatatttttagtagagacagtgtttctccatgttagccaggctggtcttgaactcctgaccagcctcaagtgatctgcctgcctccttcacccaaagtgctgggattccaggtgtgagccactgcacctggccttttttttttttatcagttacttttaaaaatgaattactttatccctttattgggatgtatttcctaagccataaatttcaccctcaccatgttttttaaactatgaattaattcacaatactcacacattgagagatttctcatggactcctggcttcctcggctatgggggccactctgtggtcatcacagaccccaccacccacctgtccttccacacccctggctcctttatgttgcttcctgccccacaggcatctgcatttagtactcatggaaatacttactctgaattatacttctgtaggctaacgtggctggggaatctggggcgtcaatgaaaaaagactggcctttgtcacaattcttaccttaaaaaagaaacaaacggaagacaattcagtccaagaggaaaacagaatggccacaagatcttggggctctttccgtgctggtgacaatgggaagatcttgagcccgcttcactcgtaatgaagaacaaagtagaaaagaccagtggggtctcagggaccttccttccagcagggtccccagccagcatttcagcgtggctaaataatcaggtggtgtacagaaaatgcaggttccagggccctacagagaactgattcagcagcttccacatgggcccaggagtctgcattttaagagattagcttttgagtgaaaggatcatgaatgcacatggttaaaaaaagtacagaatgcaaaaggatatggcataaaaggccaagtccgaaaagggctactagtgttctaggtgtctttccagaaagattatgcgcatataaatgtgcacacttgcatgtgtgcgcacacacatacacacactctcatatacctaaaatacgaatgggagcacatgacacacacattctgcctgctgctttgtctgtgtataattttatcttccaggtcatctgtgctggtgtctatcagtctgctagtctttccccgccatgtggccattgttccagtcccctcctatgcacacccaggtttctctaggaccatgttatcccagagccaggtggacaggacacaaggggctaggggtcaatgggggtgttctcgcctccagtctgccctgccagcccccagtcgtgggtggacctgccatcagcttgctctgcccactccccaggcctgagctgctggcgaaacaggcaagtgactgcactgcccatggccggtcaccagcctcaggtgaaccccaggaggggttcctacctagcactcatcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcgtacctcaagtagagggtatttaaacacaaaaactctgtaatggggcctttgagcccctattctcaggcccgttctcctcccacaccgtggagttgactttcattttcaataaatcccttccttccttccttt

SEQ ID NO: 192708 - DNA, 2987 bp, Homo sapiens
  Payload ID: 18042
  Gene Name: trans-golgi network vesicle protein 23 homolog A (S. cerevisiae)
  ENST ID: ENST00000572102
  CDS Start-End: 1-189
gtctctccgaatagcattgctgccacagaagctgaagcacgaatcttctggctgggcctcataatctgccccatgatatggattgtgtttttttttagcaccttattttccttgaagctaaagtggctggcctgcccaggtgactttcagaagcctggcctcgaggggctggagattcaccagcattaggctttcttatcttcacaggcagaaatggcttaaacgggagtttctacaatcgactaagcttccgacacagcagaatcccacgatcccacaacccatttgttttttacgtgaaacaggcctcgggggagagatttgagggggttttattcttaaaacggcacatttgtagagaatgccctttatatatgttctaaagaaaagtgtacaaatactcaatgattaaagtgtctctgagaaagtggcttcggaccacaccagcatctggtccttttgctgtgacccaccccatcccggagctggtcgggtctggctggatgtgctgcccagtgagtgcctcgctcggtaactgcttggtcctgaacattctctcgtttcaggaactgatgaggttctcttcttttgactgatggagattacaaaactcttggattcctggaaaacaagacgacaggcatagagtgctaatggcttgtctaccccttgacagccctgtcctgtgctggggagggctgtgttttgacaggggtggaatcctctggctagttccataaaaagacctgtgtctgtgatgccctgagtctttgaaagtgaccggaatacctcacactacccatcttgctcataaccagtggctgcggccttcctcggaccatctatagatggaggattctgggaatgctgtttccttacccttgacatcattcttctaggcaagtaaaacccagccacaaactcagagaccacagctttaacaaacactgacacctctgccctaactctggggcctctgatggctgccactggctgaatgtggcctgcacgtgggtttggtctggctcaacaaagtttttatttttattttttatttttttgagacacggtctcacgctgttgcccaggctggagtgcagtggcgcgatctcgccttactgcagcctccgcctcccaggttcaagcgattctcctgcctcagcctcctgagtagctgggactacaggcatgcgccaccacacccggctaattttcatatttttagtagagacagtgtttctccatgttagccaggctggtcttgaactcctgaccagcctcaagtgatctgcctgcctccttcacccaaagtgctgggattccaggtgtgagccactgcacctggccttttttttttttatcagttacttttaaaaatgaattactttatccctttattgggatgtatttcctaagccataaatttcaccctcaccatgttttttaaactatgaattaattcacaatactcacacattgagagatttctcatggactcctggcttcctcggctatgggggccactctgtggtcatcacagaccccaccacccacctgtccttccacacccctggctcctttatgttgcttcctgccccacaggcatctgcatttagtactcatggaaatacttactctgaattatacttctgtaggctaacgtggctggggaatctggggcgtcaatgaaaaaagactggcctttgtcacaattcttaccttaaaaaagaaacaaacggaagacaattcagtccaagaggaaaacagaatggccacaagatcttggggctctttccgtgctggtgacaatgggaagatcttgagcccgcttcactcgtaatgaagaacaaagtagaaaagaccagtggggtctcagggaccttccttccagcagggtccccagccagcatttcagcgtggctaaataatcaggtggtgtacagaaaatgcaggttccagggccctacagagaactgattcagcagcttccacatgggcccaggagtctgcattttaagagattagcttttgagtgaaaggatcatgaatgcacatggttaaaaaaagtacagaatgcaaaaggatatggcataaaaggccaagtccgaaaagggctactagtgttctaggtgtctttccagaaagattatgcgcatataaatgtgcacacttgcatgtgtgcgcacacacatacacacactctcatatacctaaaatacgaatgggagcacatgacacacacattctgcctgctgctttgtctgtgtataattttatcttccaggtcatctgtgctggtgtctatcagtctgctagtctttccccgccatgtggccattgttccagtcccctcctatgcacacccaggtttctctaggaccatgttatcccagagccaggtggacaggacacaaggggctaggggtcaatgggggtgttctcgcctccagtctgccctgccagcccccagtcgtgggtggacctgccatcagcttgctctgcccactccccaggcctgagctgctggcgaaacaggcaagtgactgcactgcccatggccggtcaccagcctcaggtgaaccccaggaggggttcctacctagcactcatcatttcctcaacttcactactgtgtcgccctgtgggacagggaagtccaagtcggggaagaagcctgtggggaggggttggtgggagatggggagcccatatggcccagtgagtcaggaaaatagggtccagaggcagggaacataaggccaattcgcacttgagccataacaggaaatgtcctctccataggacgtatgccgtaaatgactttgtaactttacttcatccttttcgtttatatagggcgtacctcaagtagagggtatttaaacacaaaaactctgtaatggggcctttgagcccctattctcaggcccgttctcctcccacaccgtggagttgactttcattttcaataaatcccttccttcctt

SEQ ID NO: 192709 - DNA, 667 bp, Homo sapiens
  Payload ID: 18042
  Gene Name: trans-golgi network vesicle protein 23 homolog A (S. cerevisiae)
  ENST ID: ENST00000619408
  CDS Start-End: 1-461
gcgactggttcagcaagagctttgtgggctgttttgtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggctttcttatcttcacaggcagaaatggcttaaacgggagtttctacaatcgactaagcttccgacacagcagaatcccacgatcccacaacccatttgttttttacgtgaaacaggcctcgggggagagatttgagggggttttattcttaaaacggcacatttgtagagaatgccctttatatatgttctaaagaaaagtgtacaaatactcaatgattaaagtgtctctgagaaag

SEQ ID NO: 192710 - DNA, 1298 bp, Homo sapiens; identical to SEQ ID NO: 192706
  Payload ID: 18042
  Gene Name: trans-golgi network vesicle protein 23 homolog A (S. cerevisiae)
  Uniprot ID: A6NH52
  ENST ID: ENST00000612195
  CDS Start-End: 108-749

SEQ ID NO: 192711 - DNA, 2064 bp, Homo sapiens
  Payload ID: 18043
  Gene Name: trans-golgi network vesicle protein 23 homolog B (S. cerevisiae)
  Uniprot ID: Q9NYZ1
  ENST ID: ENST00000307767
  CDS Start-End: 300-917
gacagcaaatacttccgtaaaacagaccatgaagctttccacttagagcccactgtggccccaatacctttccctttcgctcctgctccaggctccgcctccgccgtgtccgggccgctcgccccgcccccgctcgccccgcccctggatttgctccctcaaagcggaagtgaggccggactgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctatttaaggcccagttaatataagtggaatcatcatagtttaaggaatacccagagattgctgctgttctatttattttacagaaaggatagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggca

SEQ ID NO: 192712 - DNA, 1049 bp, Homo sapiens
  Payload ID: 18043
  Gene Name: trans-golgi network vesicle protein 23 homolog B (S. cerevisiae)
  ENST ID: ENST00000574294
  CDS Start-End: 184-345
gctcgccccgcccccgctcgccccgcccctggatttgctccctcaaagcggaagtgaggccggactgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatgga

SEQ ID NO: 192713 - DNA, 718 bp, Homo sapiens
  Payload ID: 18043
  Gene Name: trans-golgi network vesicle protein 23 homolog B (S. cerevisiae)
  ENST ID: ENST00000571018
  CDS Start-End: 152-265
atttgctccctcaaagcggaagtgaggccggactgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggag

SEQ ID NO: 192714 - DNA, 1080 bp, Homo sapiens
  Payload ID: 18043
  Gene Name: trans-golgi network vesicle protein 23 homolog B (S. cerevisiae)
  ENST ID: ENST00000574226
  CDS Start-End: 140-751
aaagcggaagtgaggccggactgaggctcttacagtggtccctgctggcccttggtgacgggtcgcctcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaagtaagtgttttctggatgtgatcagtgactaatgcaattatttctaactttcatagtttaatttttatgaaacgctcctgaacagaagttttaaaggcatatagttgtataaatataatgataaagatgttgtaattgctctttgggggtgttcaagacagtctggaagtgtattgtcagtatcctaaaattattttaaagccaggaaggataaactatcattgataataacttattttttaaaaattacttttaagttcagttgtttttcatcaattatgggagctttaagtgaatgcccttgcagaatgtatgttgtatgttttttttttttttttttgagacagagt

SEQ ID NO: 192715 - DNA, 2989 bp, Homo sapiens
  Payload ID: 18043
  Gene Name: trans-golgi network vesicle protein 23 homolog B (S. cerevisiae)
  ENST ID: ENST00000476139
  CDS Start-End: 1417-1842
ctgagggctcgctgggagggtggcggctcctgggactggctctgcaggttccgtgggactggagcccgcgtcccccgcgcccgctactcgaactcgaggaggagcggggcggccgggagtggagggctgtgggtagttgtctgaggagggctgctgggggttctgaggccgctgggggcggcgtgacccgtgcggcgcagagcaagtacttcttgcggctgtggggacgcccattgttaaccagcgcgagtgggggtctctctttcctcaacccttattgccggggtggagttgaggaggagcggcctgcgggcctcttagcttcctgacacccaggggtgcgatgctattttgtaggaatcggcgacaccgccagagcctcgctttcaaattgctgtttccaaactaatgttgttggtgattctctcctttgtgctcttagagttaattgtagtccacatgttggcaaccagagactcgtaagattaataatatttttagaaaaaactactgtttatggtcacttagattgtcttaagtgtttttttctttcggttcacacaaaatttgttgagggattactatgactcagacacggttgtaggcccagggatagggttgtgaccagtacagacaggtttcttgccccgtatttttgggttagggaagtgggttctaggagatgggggttgggtggggagacacgataaattgtataaccaaagatattttcagataattgcaaaggcagggtgatgaaataacaagtgtctgaggataggacaactaagatttatggtcaggaaagactgcttatgaggagatgccttgagtggagaaaatctaataatggttaaattcagctgtattacaggaaaggtgtcccgatccagacccgaaaagagggtccttggccgggcgtggtgactcaggcctgtaatcccagcactttgggaggacgaggtgggtggatcatgaggtcaagagatcgagaccatcctggccaacttggtgaaaccctgtctctactaaaaatacaaaaattagttgggcgtgatggtgcacgcctgtagtcccagctactcgggaggctgaggcaggagaatcgcttgaactggggaggctgaggttgcagtgagccgcgggccactgcactccatccagcctggctacagagggagactccgtctcaaacaaaacaaaaaaagtcttggatcaggcaagaaggaattcagggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctatttaaggcccagttaatataagtggaatcatcatagtttaaggaatacccagagattgctgctgttctatttattttacagaaaggatagctagattgaaagctcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggca

SEQ ID NO: 192716 - DNA, 1258 bp, Homo sapiens
  Payload ID: 18043
  Gene Name: trans-golgi network vesicle protein 23 homolog B (S. cerevisiae)
  ENST ID: ENST00000581733
  CDS Start-End: 198-623
gacttgggagagaacaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatgtgttggcactagaaacattgtcaagatttgttctgtggtgtaggtatgcacattccataggtatgcacacggccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggtattaactactttataaaattttatttttgtttgtaagaagtcatctatttaaggcccagttaatataagtg

SEQ ID NO: 192717 - DNA, 697 bp, Homo sapiens
  Payload ID: 18043
  Gene Name: trans-golgi network vesicle protein 23 homolog B (S. cerevisiae)
  ENST ID: ENST00000575261
  CDS Start-End: 302-697
gctcttacagtggtccctgctggcccttggtgacgggtcgcctcagttccgacccggacccgtacgctgctgcgctgacgtggctcccggaagtagggctggcgtagggccgccatgttgcagcagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgtccagtactgtgggtgatatttgcttttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaaga

SEQ ID NO: 192718 - DNA, 1527 bp, Homo sapiens
  Payload ID: 18044
  Gene Name: trans-golgi network vesicle protein 23 homolog C (S. cerevisiae)
  Uniprot ID: Q96ET8
  ENST ID: ENST00000225576
  CDS Start-End: 97-927
gctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctgagacggtctcgccacattgcccagactggtctgaaagtcttgggctcaagagatcctcccgcttccgccttccaaagcgctgggataacaggcgtgagccgctgcccgggccatccctcgaggaagtttcatcaggtagacattaattctttcacgaggatcacggatcgagctctttactggaaacctgcgccccgccttagttctccacctcttcgtgcggctccaggcaactgccaacagatggcgcccgcccgcctatttctctccttgcggctttgggcctggaggggaggtggggagagtcccaatagcagaggaactggtgagcccgggccaaaatttcatctggcatccggaatgcattaaaaacaacccacaaatctgaagctcctcgcaggagagagagagagagagagagaggagagagaggagagaggagagagggagggaagagagtgacggagaaggagagaaagagacgggagagaggagagagaaagagagagagaggagagagagaaagaacgaacgaacagggaacttgtaaaactaaggggaaaagggcagaagagaggcagcagcgtggtccctgcaagcgtccgctttcctggccaagcagcccccagcacgcctgctttgtggggcagggccatgcggccccgaggaaggatgcggtgagccagagggttccagacaaaggaggggatccccaaggctctgggccagccagtccctgttttactggcaccacggtccctcctaggcgaggacgaagagggaaggggtggagacctccaccttctctgcgtgtggctgcgtccctttacagaatgacaggcccttacttccgagggcggggactaatgtgtaaggcttaacagatccaattccagaaattatctgtgtttttttcaatcaccctcttgtgcccccccaccccccattaaatttcatcttttatctttt

SEQ ID NO: 192719 - DNA, 1911 bp, Homo sapiens
  Payload ID: 18044
  Gene Name: trans-golgi network vesicle protein 23 homolog C (S. cerevisiae)
  ENST ID: ENST00000428082
  CDS Start-End: 148-765
gctccctcaaagcggaggtgaggccggactgaggctcttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagttaatgaaagtgttcatttacacagataatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgtacttcatggggaaatttcttagacgtatgcaagcaagtgaaaacaattagggccagtggtattaactactttataaaattttatttttgtttgtaagaagttatctacttaaggcccagttaatataagtggaatcatcatagtttaaggaatacccagagattgctgctattctatttattttacagaaaggatagctagattgaaagttcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggc

SEQ ID NO: 192720 - DNA, 537 bp, Homo sapiens
  Payload ID: 18044
  Gene Name: trans-golgi network vesicle protein 23 homolog C (S. cerevisiae)
  ENST ID: ENST00000419890
  CDS Start-End: 208-537
agggctggcgtagggccgccatgttgcagcagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgt

SEQ ID NO: 192721 - DNA, 1852 bp, Homo sapiens
  Payload ID: 18044
  Gene Name: trans-golgi network vesicle protein 23 homolog C (S. cerevisiae)
  ENST ID: ENST00000438826
  CDS Start-End: 89-706
ttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagttaatgaaagtgttcatttacacagataatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgtacttcatggggaaatttcttagacgtatgcaagcaagtgaaaacaattagggccagtggtattaactactttataaaattttatttttgtttgtaagaagttatctacttaaggcccagttaatataagtggaatcatcatagtttaaggaatacccagagattgctgctattctatttattttacagaaaggatagctagattgaaagttcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggc

SEQ ID NO: 192722 - DNA, 591 bp, Homo sapiens
  Payload ID: 18044
  Gene Name: trans-golgi network vesicle protein 23 homolog C (S. cerevisiae)
  ENST ID: ENST00000521179
  CDS Start-End: 25-138
aagcagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggag

SEQ ID NO: 192723 - DNA, 764 bp, Homo sapiens
  Payload ID: 18044
  Gene Name: trans-golgi network vesicle protein 23 homolog C (S. cerevisiae)
  ENST ID: ENST00000523573
  CDS Start-End: 1-162
atgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatt

SEQ ID NO: 192724 - DNA, 2989 bp, Homo sapiens
  Payload ID: 18044
  Gene Name: trans-golgi network vesicle protein 23 homolog C (S. cerevisiae)
  ENST ID: ENST00000584811
  CDS Start-End: 1417-1842
ctgagggcgcgctgggagggtggcggctcctgggactggctctgcaggttccgtgggactggagcccgcgtcccccgcgcccgctactcgaactcgaggaggagcggggcggccgggagtggagggctgtgggtagttgtctgaggagggctgctgggggttctgaggccgctgggggaggcgtgacccgtgcggcgcagagcaagtacttcttgcggctgtggggacgcccattgttaaccagcgcgagtgggggtctctctttcctcaacccttattgccggggtggagttgaggaggagcggcctgcgggcctcttagcttcctgacacccaggggtgcgatgctatcttgtaggaatcggcgacaccgccagagcctcgctttcaaattgctgtttccaaactaatgttgttggtgattctctcctttgtgctcttagagttaattgtagtccacatgttggcaaccagagactcgtaagattaataatatttttagaaaaaactactgtttatggtcacttagattgtcttaagtgtttttttctttcggttcacacaaaatttgttgagggattactatgactcagacacggttgtaggcccagggatagggttgtgaccagtacagacaggtttcttgccccgtattttcgggttagggaagtgggttctaggagatgggggttgggtggggagacacgataaattgtataaccaaagatattttcagataattgcaaaggcagggtgatgaaataacaagtgtccgaggataggacaactaagatttatggtcaggaaagactgcttatgaggagatgccttgagtggagaaaatctaataatggttaaattcagctgtattacaggaaaggtgtcccgatccagacccgaaaagagggtccttggccgggcgtggtgactcaggcctgtaatcccagcactttgggaggacgaggtgggtggatcatgaggtcaagagatcgagaccatcctggccaacttggtgaaaccctgtctctactaaaaatacaaaaattagttgggcgtgatgatgcacgcctgtagtcccagctactcgggaggctgaggcaggagaatcgcttgaactggggaggccgaggttgcagtgagccgcgggccactgcactccatccagcctggctacagagggagactccgtctcaaacaaaacaaaaaaagtcttggatcaggcaagaaggaattcagggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaaaacactggagatgatcagacttcctgaatagagaaagcttatgtgctttgttacattggggaacaactgaagagattcttgactcaaccttttagagcttagtccatgttgcaacgaggagtgttggctttgtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagttaatgaaagtgttcatttacacagataatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgtacttcatggggaaatttcttagacgtatgcaagcaagtgaaaacaattagggccagtggtattaactactttataaaattttatttttgtttgtaagaagttatctacttaaggcccagttaatataagtggaatcatcatagtttaaggaatacccagagattgctgctattctatttattttacagaaaggatagctagattgaaagttcttcagtggaccttgagctaatagatcttttaccactaaaagagcattattctcatgtcataatgagaataataatttacatacttggcataataaatgcctaaaagacattttattttctgaatctatttttttcttgctataatggggatattgtaaattatgcatttgtattaatggtatttcttaaagcaatctatgtaactgtaaattaaaccaatctacaaactattgtaggcatctgtaaattctgttgtaggtattataaactttgttgaagtcttaatcagcagattatgttgtgaatatatttgtacattgttaaaatagtttttaagattatttgtttaattgaataagtgtcttattggagtgatagctttgaaggtgcaaaactttatatttgtataaaattctactatttacaaggca

SEQ ID NO: 192725 - DNA, 1080 bp, Homo sapiens
  Payload ID: 18044
  Gene Name: trans-golgi network vesicle protein 23 homolog C (S. cerevisiae)
  Uniprot ID: Q96ET8
  ENST ID: ENST00000518321
  CDS Start-End: 140-751
aaagcggaggtgaggccggactgaggctcttacagtggtccctgctggcccttggtgacgggtcgcgtcagttccgacccggacccgtacgctgctgcgctgacgtggctcctggaagcagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctgtcttctctgtgagttgctcagcagcagctttattacctgtatggttacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatcttttggttgggacttattgcctgttcagtactgtgggtgatatttgcctttagtgcactcttctccttcacagtaaagtggctggcggtggttattatgggtgtggtgctacaaggtgccaacctgtatggttacatcaggtgtaaggtgcgcagcagaaagcatttaaccagcatggctacttcatattttggaaagcagtttttaagacaagtaagtgttttctggatgtgatcagtgactaatgcaattatttctaactttcatagtttaatttttatgaaacgctcctgaacagaagttttaaaggcatatagttgtataaatataatgataaagatgttgtaattgctctttgggggtgttcaagacagtctggaagtgtattgtcagtatcctaaaattattttaaagccaggaaggataaactatcattgataataacttattttttaaaaattacttttaagttcagttgtttttcatcaattatgggagctttaagtgaatgcccttgcagaatgtatgttgtatgtttttatttttattttttgagacagagt

SEQ ID NO: 192726 - DNA, 488 bp, Homo sapiens
  Payload ID: 18044
  Gene Name: trans-golgi network vesicle protein 23 homolog C (S. cerevisiae)
  ENST ID: ENST00000581273
  CDS Start-End: 1-183
gagtcctctcaagagaataaaactgtgtcagaggctgaatcaagaatcttttggttgggacttattgcctgttcagtactgtgggtgatatttgcctttagtgcactcttctccttcacagtaaagtggctggtgactgtatttggagacaggacctttaaagacatgattaagataaaatgaggtcatatgggtaggccttaattcagtctgactggtgttccataagaagaggatattaggacacagacacacagaggaaggaccgtgtgaagacgaagggggaagatgccgtccacaagccaaggagagaggccttagaggaaaccagccctgctgacaccttgatcttgggcttccagtctccagaacttgcttagagcatgaaagttttctgccgtctttggaatcttgtttgcaaacagctcaaaggagatgcggcccaagggctccccgttgatggcgatgttgaagaacatggtggggtt

SEQ ID NO: 192727 - DNA, 5223 bp, Homo sapiens
  Payload ID: 18045
  Gene Name: transient receptor potential cation channel, subfamily A, member 1
  Uniprot ID: O75762
  ENST ID: ENST00000262209
  CDS Start-End: 209-3568
actacaaaagtagcgcgggcctgagaactccttccagaagttctccagggcttccgcagagcgactttttcgctgcctgtgagctgcagcgcgggagagctcgggctcgcgcggaccccagcgcctggcaggctgacagcgctctctcgccccaggtgcccgcgcgcgtggtgagcagctgcaccaggtggcgtccggggtggggtcaatgaagcgcagcctgaggaagatgtggcgccctggagaaaagaaggagccccagggcgttgtctatgaggatgtgccggacgacacggaggatttcaaggaatcgcttaaggtggtttttgaaggaagtgcatatggattacaaaactttaataagcaaaagaaattaaaaagatgtgacgatatggacaccttcttcttgcattatgctgcagcagaaggccaaattgagctaatggagaagatcaccagagattcctctttggaagtgctgcatgaaatggatgattatggaaatacccctctgcattgtgctgtagaaaaaaaccaaattgaaagcgttaagtttcttctcagcagaggagcaaacccaaatctccgaaacttcaacatgatggctcctctccacatagctgtgcagggcatgaataatgaggtgatgaaggtcttgcttgagcatagaactattgatgttaatttggaaggagaaaatggaaacacagctgtgatcattgcgtgcaccacaaataatagcgaagcattgcagattttgcttaaaaaaggagctaagccatgtaaatcaaataaatggggatgtttccctattcaccaagctgcattttcaggttccaaagaatgcatggaaataatactaaggtttggtgaagagcatgggtacagtagacagttgcacattaactttatgaataatgggaaagccacccctctccacctggctgtgcaaaatggtgacttggaaatgatcaaaatgtgcctggacaatggtgcacaaatagacccagtggagaagggaaggtgcacagccattcattttgctgccacccagggagccactgagattgttaaactgatgatatcgtcctattctggtagcgtggatattgttaacacaaccgatggatgtcatgagaccatgcttcacagagcttcattgtttgatcaccatgagctagcagactatttaatttcagtgggagcagatattaataagatcgattctgaaggacgctctccacttatattagcaactgcttctgcatcttggaatattgtaaatttgctactctctaaaggtgcccaagtagacataaaagataattttggacgtaattttctgcatttaactgtacagcaaccttatggattaaaaaatctgcgacctgaatttatgcagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcctggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggctgaaggatcttacttttctcctggaaaaacagcatgagctcattaaactgatcattcagaagatggagatcatctctgagacagaggatgatgatagccattgttcttttcaagacaggtttaagaaagagcagatggaacaaaggaatagcagatggaatactgtgttgagagcagtcaaggcaaaaacacaccatcttgagccttagctcctcagaccttcagtgaggcttctaatggggggtgcatgacttgctggttctaactttcaatttaaaaagagtgaggaagaagcagaatgattcattttgctgcgtgtgaaatcatggttcctgcatgctgtataaaagtaaaccatcttttatcctctattcatattttctaccaatcactatgtattggggatatctttgcagatatgttcaaattggactggactttgatgagatataatctcattatttgaatgggtagaaaatgaatttgctagaacacacatttttaatgaaaagaagtaataaatgtaactattaagctaaaatgcaaatgtcagtactgaattcctgcttgttaattacataatatgtgatgctctagaaaatagtcacaagtattaataatgccttagatgatagtcttaaatattaggttgaggtctacctaacctaagctgcttcctggaaagcttcatgttgaaagaacctatgggtggcaccatgtggacttttctgtccctactgtgatgaatagccccacccttcttgctgtccccaacacacctgatgtcactttgagccatatagttgaagtacaaattaataggccttatgatatgcacgaattttactatagataatatatgttgtttctggttttgtttgccaatgagcataataaatgtaaaacctatatagtatccctgtgattattgtatgagcctttgtttgagatttgaaaacaacatggctccatcacatattcccttttttcttttgatgtctactcaaatcatgaattaatcacatacctcatcattaatcttttcaaggtccttctattgttttgtctgattttctccatcatcctgattagcatgtttattccctcactacccccaggagatattcactgtaatgaatatgtctttggctatgtatgtgtccttgtgttatgttgtacagtgttgttttgagtctgttattatttacacagatgttattatgctatagcttctatttctgtttttgcttcttatttctcttataattctcacttatttcctattttttctactcatttctatttgttactcctttttactggacatgatgtttacaagatacaactgtgttactgtattccatctagtacggggcctttggtgtggcttactatttcattgtgtgcacccacccacccaccacactggacttttctagagatggacagcttggttacctccaccttcctgcactcattctcaaacatactgatgttcatacaaaccagcagagtgctgagggacgatatgtactattacaaaaccagacacttttacattcatggtccaacagatcacatggcctagaggcaatgttgcatataccttaatctttgatatgaataatatctttgttctttatatttcttaaaacagaaagggtggaaaatcactatacagaagcaatatccaaagatctcctgatcataaagacaaggggtcttttcagtcttccctctcctcaaaccttgtgtagcattgcacaatatagatctcagtcaacattcactgagtgccaagaatgtgagaaacactgtaccatgcctgtcatgcgaaatatttaaataaacagattgtcttaca

SEQ ID NO: 192728 - DNA, 2812 bp, Homo sapiens
  Payload ID: 18045
  Gene Name: transient receptor potential cation channel, subfamily A, member 1
  ENST ID: ENST00000523582
  CDS Start-End: 1-2751
gtcttgcttgagcatagaactattgatgttaatttggaaggagaaaatggaaacacagctgtgatcattgcgtgcaccacaaataatagcgaagcattgcagattttgcttaaaaaaggagctaagccatgtaaatcaaataaatggggatgtttccctattcaccaagctgcattttcaggttccaaagaatgcatggaaataatactaaggtttggtgaagagcatgggtacagtagacagttgcacattaactttatgaataatgggaaagccacccctctccacctggctgtgcaaaatggtgacttggaaatgatcaaaatgtgcctggacaatggtgcacaaatagacccagtggagaagggaaggtgcacagccattcattttgctgccacccagggagccactgagattgttaaactgatgatatcgtcctattctggtagcgtggatattgttaacacaaccgatggatgtcatgagaccatgcttcacagagcttcattgtttgatcaccatgagctagcagactatttaatttcagtgggagcagatattaataagatcgattctgaaggacgctctccacttatattagcaactgcttctgcatcttggaatattgtaaatttgctactctctaaaggtgcccaagtagacataaaagataattttggacgtaattttctgcatttaactgtacagcaaccttatggattaaaaaatctgcgacctgaatttatgcagatgcaacagatcaaagagctggtaatggatgaagacaacgatgggtgtactcctctacattatgcatgtagacaggggggccctggttctgtaaataacctacttggctttaatgtgtccattcattccaaaagcaaagataagaaatcacctctgcattttgcagccagttatgggcgtatcaatacctgtcagaggctcctacaagacataagtgatacgaggcttctgaatgaaggtgaccttcatggaatgactcctctccatctggcagcaaagaatggacatgataaagtagttcagcttcttctgaaaaaaggtgcattgtttctcagtgaccacaatggctggacagctttgcatcatgcgtccatgggcgggtacactcagaccatgaaggtcattcttgatactaatttgaagtgcacagatcgcctggatgaagacgggaacactgcacttcactttgctgcaagggaaggccacgccaaagccgttgcgcttcttctgagccacaatgctgacatagtcctgaacaagcagcaggcctcctttttgcaccttgcacttcacaataagaggaaggaggttgttcttacgatcatcaggagcaaaagatgggatgaatgtcttaagattttcagtcataattctccaggcaataaatgtccaattacagaaatgatagaatacctccctgaatgcatgaaggtacttttagatttctgcatgttgcattccacagaagacaagtcctgccgagactattatatcgagtataatttcaaatatcttcaatgtccattagaattcaccaaaaaaacacctacacaggatgttatatatgaaccgcttacagccctcaacgcaatggtacaaaataaccgcatagagcttctcaatcatcctgtgtgtaaagaatatttactcatgaaatggttggcttatggatttagagctcatatgatgaatttaggatcttactgtcttggtctcatacctatgaccattctcgttgtcaatataaaaccaggaatggctttcaactcaactggcatcatcaatgaaactagtgatcattcagaaatactagataccacgaattcatatctaataaaaacttgtatgattttagtgtttttatcaagtatatttgggtattgcaaagaagcggggcaaattttccaacagaaaaggaattattttatggatataagcaatgttcttgaatggattatctacacgacgggcatcatttttgtgctgcccttgtttgttgaaataccagctcatctgcagtggcaatgtggagcaattgctgtttacttctattggatgaatttcttattgtatcttcaaagatttgaaaattgtggaatttttattgttatgttggaggtaattttgaaaactttgttgaggtctacagttgtatttatcttccttcttctggcttttggactcagcttttacatcctcctgaatttacaggatcccttcagctctccattgctttctataatccagaccttcagcatgatgctaggagatatcaattatcgagagtccttcctagaaccatatctgagaaatgaattggcacatccagttctgtcctttgcacaacttgtttccttcacaatatttgtcccaattgtcctcatgaatttacttattggtttggcagttggcgacattgctgaggtccagaaacatgcatcattgaagaggatagctatgcaggtggaacttcataccagcttagagaagaagctgccactttggtttctacgcaaagtggatcagaaatccaccatcgtgtatcccaacaaacccagatctggtgggatgttattccatatattctgttttttattttgcactggggaaataagacaagaaataccaaatgctgataaatctttagaaatggaaatattaaagcagaaataccggaagacaacttgtgccttcgtactgactctaattcctgttggttgagtgactctgggcatatgtcctcctctctaaaatgatgatgatagaatatattctttatggt

SEQ ID NO: 192729 - DNA, 4324 bp, Homo sapiens
  Payload ID: 18046
  Gene Name: transient receptor potential cation channel, subfamily C, member 1
  Uniprot ID: P48995
  ENST ID: ENST00000273482
  CDS Start-End: 392-2671
atctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgcccttcggggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaa

SEQ ID NO: 192730 - DNA, 397 bp, Homo sapiens
  Payload ID: 18046
  Gene Name: transient receptor potential cation channel, subfamily C, member 1
  ENST ID: ENST00000460401
  CDS Start-End: 1-196
ggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaaggaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgttt

SEQ ID NO: 192731 - DNA, 3061 bp, Homo sapiens
  Payload ID: 18046
  Gene Name: transient receptor potential cation channel, subfamily C, member 1
  Uniprot ID: P48995
  ENST ID: ENST00000476941
  CDS Start-End: 487-2868
gcgaacatctcctcggagcgcagctgggccagcggttcccacagccctggagcccaacgtgcgcagaagcgcctcttggagctcctctcccacagatctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgcccttcggggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagtctgcagatgcacttttggtggcaatcgactctgaagtagtgggagctgttgatatactacttaatcatcgaccaaaacgatcatcaagaccaactatagtaaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgtt

SEQ ID NO: 192732 - DNA, 3620 bp, Homo sapiens
  Payload ID: 18046
  Gene Name: transient receptor potential cation channel, subfamily C, member 1
  Uniprot ID: P48995
  ENST ID: ENST00000612385
  CDS Start-End: 56-2335
ccgaggcagcagtgggaacgactcatcctttttccagcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgc

SEQ ID NO: 192733 - DNA, 3675 bp, Homo sapiens
  Payload ID: 18047
  Gene Name: transient receptor potential cation channel, subfamily C, member 3
  Uniprot ID: Q13507
  ENST ID: ENST00000264811
  CDS Start-End: 420-2966
aattaacttctcttagtcttcaagcctagtacttgaatgtcaagtacctgcaagcctcaatgtccaagacttttaagagcggaaggtacgatgagttccatctttactagggtcacaaggaaggcatgggtatatggaaatttttattattattccatctgaatatcattttctagagaataggagcttttgttctgaagggctgccggcttccttctgggatctagcagccagggttagatcacaggtgtcactttcaggcgagtagttagcaacggtatcgctagcaactgagccgacccctgcagccagaggtttgcagtgggtagtgtgtattccagaaagggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatata

SEQ ID NO: 192734 - DNA, 3548 bp, Homo sapiens
  Payload ID: 18047
  Gene Name: transient receptor potential cation channel, subfamily C, member 3
  Uniprot ID: Q13507
  ENST ID: ENST00000379645
  CDS Start-End: 75-2840
gggaagactgcactgccgcgaaggcggaggaggccggcagccggcacccccacactcggaccgcagccggcgcgatgtccaccaaggtcaggaagtgcaaagaacaagcaagggtgaccttcccggcgccggaggaggaggaagacgagggcgaggacgagggcgcggagccgcagcgccgccgccggggctggaggggcgtcaacggggggctggagccgcgctcggcgccctcgcagcgggagccgcacggctactgcccgccgcccttctcccacgggccggacctgtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatat

SEQ ID NO: 192735 - DNA, 619 bp, Homo sapiens
  Payload ID: 18047
  Gene Name: transient receptor potential cation channel, subfamily C, member 3
  ENST ID: ENST00000502968
  CDS Start-End: 341-619
cgtctctctgtggttcagtcacatttggggtaaaactggaaccgaagccctatagggtcccctgagggagagagtgggcatcgggcagccggggaaccgctttagtgataactttgactgcggttcccaggcggtgcagggtcagcggctcgcgccccggcgcgcgggctctctttttctctttctttctttccctctctctctttctaaacgaaggagcggtcggcgcgctaatgcatgagaaagagcaacttttcttaatttccaatcttggagacagcttttaatcagtgcgagacgcagagaagataaaaagagggtgatcggtttcacagggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctg

SEQ ID NO: 192736 - DNA, 2700 bp, Homo sapiens
  Payload ID: 18047
  Gene Name: transient receptor potential cation channel, subfamily C, member 3
  ENST ID: ENST00000506449
  CDS Start-End: 76-906
gggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagatctcagagcaagttgaaaactccaaattccgtttagagacagtagaaaagcatttagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggc

SEQ ID NO: 192737 - DNA, 2382 bp, Homo sapiens
  Payload ID: 18047
  Gene Name: transient receptor potential cation channel, subfamily C, member 3
  ENST ID: ENST00000513531
  CDS Start-End: 1-2382
atggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatga

SEQ ID NO: 192738 - DNA, 2912 bp, Homo sapiens
  Payload ID: 18048
  Gene Name: transient receptor potential cation channel, subfamily C, member 4
  Uniprot ID: Q9UBN4
  ENST ID: ENST00000338947
  CDS Start-End: 236-2650
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgtattcttgtactgttgc

SEQ ID NO: 192739 - DNA, 2784 bp, Homo sapiens
  Payload ID: 18048
  Gene Name: transient receptor potential cation channel, subfamily C, member 4
  Uniprot ID: Q9UBN4
  ENST ID: ENST00000355779
  CDS Start-End: 236-2746
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtat

SEQ ID NO: 192740 - DNA, 2955 bp, Homo sapiens
  Payload ID: 18048
  Gene Name: transient receptor potential cation channel, subfamily C, member 4
  Uniprot ID: Q9UBN4
  ENST ID: ENST00000358477
  CDS Start-End: 236-2917
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtat

SEQ ID NO: 192741 - DNA, 2760 bp, Homo sapiens
  Payload ID: 18048
  Gene Name: transient receptor potential cation channel, subfamily C, member 4
  Uniprot ID: Q9UBN4
  ENST ID: ENST00000379673
  CDS Start-End: 236-2722
cttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtat

SEQ ID NO: 192742 - DNA, 2475 bp, Homo sapiens
  Payload ID: 18048
  Gene Name: transient receptor potential cation channel, subfamily C, member 4
  Uniprot ID: Q9UBN4
  ENST ID: ENST00000379679
  CDS Start-End: 1-2415
atggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtggg

SEQ ID NO: 192743 - DNA, 4059 bp, Homo sapiens
  Payload ID: 18048
  Gene Name: transient receptor potential cation channel, subfamily C, member 4
  Uniprot ID: Q9UBN4
  ENST ID: ENST00000379705
  CDS Start-End: 859-3792
agtcgcccagagaagcgggagtgggagaagctttgagagttgcaggggactacttttttccggtcgggcggcgggcctcatgggtgcttgtttaccgggctgggagcagggcattcaaaagctgggtgtcggagcgcactgaagtccaacacgcctgcagagaccgccctaagcctggaggtgtgtctggcttgcatccagaaccacagggtggattctcgccaccgacttggctggatgacggctggctggtggtgagctcccctgcccactggctgacctcaagcagttggccccggtaggtggaggctattcgagggggacaagctggggacgcagcgtcagctcctgccagcgcgcgggtctcctccacctccaagcagtgtggtgcgtgggacgcgcatcttcccggactatccctttccagcgcggtctgtgcggaccccgagcccggcagccaccagggacggagggcggggtgcctttctctgggctcatccgctgtcagccgtgggaactcttaactttatccagagggatctgtgcaggcgggggtgggagaggttctcctcccctggcggttacctccccctcccgggccgcccctcccccgcctcccatggcttcgctttcagagcatcctcactccgcccagttcggtgccagctgcgtgggctccagcttcgatcgttttccttggaatgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtgggggaaaatgtttaaattgtattagcaaatgctaacttacactttatagcgtttatcagctgtggcatattacctgtaacatgtttaaataaggcaaaggcaatcaaaaacctttttgttttgtagcctgcttttgctttcacaatttgtcttacaattgtttttgttaataaataaatgcaccttgtattcttgtactgttgcaataa

SEQ ID NO: 192744 - DNA, 2709 bp, Homo sapiens
  Payload ID: 18048
  Gene Name: transient receptor potential cation channel, subfamily C, member 4
  ENST ID: ENST00000426868
  CDS Start-End: 157-1539
tgctccaaaactcagcagcgactaagggaattccattggaatttgccgggcgtgctctcaccccgcacggcacccgcgccgtcagtcctcggatcccatcacttcagcccgaagattgcaactttgcagagacgaagaaatagcatggcatgaaacatggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaaggttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagtaagttgtccttgtactatgtcttgaaattttcactaaaataaaatgcagtccccccttcagaactgactcaggaggaaatttatttactcattgagtatcaatactcttgttctaaaatgcctcaggaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtggg

SEQ ID NO: 192745 - DNA, 2657 bp, Homo sapiens
  Payload ID: 18048
  Gene Name: transient receptor potential cation channel, subfamily C, member 4
  Uniprot ID: Q9UBN4
  ENST ID: ENST00000488717
  CDS Start-End: 1-972
atggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagaggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaatagggaggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtggg

SEQ ID NO: 192746 - DNA, 3009 bp, Homo sapiens
  Payload ID: 18048
  Gene Name: transient receptor potential cation channel, subfamily C, member 4
  Uniprot ID: Q9UBN4
  ENST ID: ENST00000625583
  CDS Start-End: 1-2949
atggctcagttctattacaaaagaaatgttaatgctccctatagagaccgcatccctctaaggatagtaagagcagaatcagaactctcgccatcagaaaaagcctacttgaatgctgtggaaaagggagattatgccagtgtcaagaaatccctagaggaagctgaaatttattttaaaatcaatattaattgcattgatcctctcggaagaactgctctcctcattgcaattgaaaatgagaacttggagctcatcgaactactcttaagctttaatgtctatgttggagatgctctattacatgctatcagaaaagaagtcgtcggagctgttgagctgttattgaaccacaaaaaacctagtggagaaaaacaggtgcctcctatactccttgataagcagttctctgaattcactccagacattacaccaatcattttggcagcccatacaaataattatgagataataaaactcttggttcagaaaggagtctcagtgcctcgaccccacgaggtccgctgtaactgtgtggaatgcgtgtccagttcagatgtggacagcctccgtcactcacgctccagactcaacatctacaaggccttggccagtccctctctcattgcactgtcaagcgaagatccttttctcacagcctttcagttaagttgggaacttcaggaactgagcaaggtggaaaatgaattcaagtcggagtatgaagagctgtcacggcagtgcaaacaatttgctaaggacctactggatcagacgagaagttccagagaactggaaatcattcttaattaccgagatgacaatagtctcatagaagaacaaagtggaaatgatcttgcaagactaaaattggccattaagtaccgtcaaaaagagtttgttgcccagcccaattgtcaacagctgctggcatctcgctggtacgatgagtttccaggctggaggagaagacactgggcagtgaagatggtgacatgtttcataataggacttctttttcctgtcttctctgtgtgctacctgatagctcccaaaagcccacttggactgttcatcaggaagccatttatcaagtttatctgccacacagcctcctatttgacttttttgttcctgctgctgcttgcctctcagcacatcgacaggtcagacttgaacaggcaaggtccaccaccaaccatcgtcgagtggatgatattaccgtgggtcctgggcttcatatggggagaaattaaacagatgtgggatggcggacttcaggactacatccatgattggtggaatctaatggactttgtaatgaactccttatatttagcaacaatctccttgaaaattgttgcatttgtaaagtacagtgcccttaatccacgagaatcatgggacatgtggcatcccactctggtggcagaggctttatttgctattgcaaacatcttcagttctctgcgtctgatctcactgtttactgcaaattctcacctgggacctctgcaaatatctctgggaagaatgctcctggacattttgaagtttctattcatatactgccttgtgttgctagcatttgcaaatggcctaaatcaattgtacttctattatgaagaaacgaaagggttaacctgcaaaggcataagatgtgaaaagcagaataatgcattttcaacgttatttgagacactgcagtccctgttttggtcaatatttgggctcatcaatttatatgtgaccaatgtcaaagcacagcatgaatttactgagtttgttggtgccaccatgtttgggacatacaatgtcatctctctggttgttctactcaacatgttaatagctatgatgaataattcttaccaactgattgctgaccatgcagatatagaatggaaatttgcacgaacaaagctttggatgagttattttgaagaaggaggtactctgcctactcccttcaatgtcatcccgagccccaagtctctctggtacctgatcaaatggatctggacacacttgtgcaagaaaaagatgagaagaaagccagaaagttttggaacaataggggtaagaacacagcataggcgagctgctgataacttgagaagacatcaccaataccaagaagttatgaggaacctggtgaagcgatacgttgctgcaatgattagagatgctaaaactgaagaaggcctgaccgaagagaactttaaggaactaaagcaagacatttctagtttccgctttgaagtcctgggattactaagaggaagcaaactttccacaatacaatctgcgaatgcctcgaaggagtcttcaaattcggcagactcagatgaaaagagtgatagcgaaggtaatagcaaggacaagaaaaagaatttcagcctttttgatttaaccaccctgattcatccgagatcagcagcaattgcctctgaaagacataacataagcaatggctctgccctggtggttcaggagccgcccagggagaagcagagaaaagtgaattttgtgaccgatatcaaaaactttgggttatttcatagacgatcaaaacaaaatgctgctgagcaaaatgcaaaccaaatcttctctgtttcagaagaagttgctcgtcaacaggctgcaggaccacttgagagaaatattcaactggaatctcgaggattagcttcacggggtgacctgagcattcccggtctcagtgaacaatgtgtgttagtagaccatagagaaaggaatacggacacactggggttacaggtaggaaagagagtgtgtccattcaagtcagagaaggtggtggtggaggacacggttcctataataccaaaggagaaacatgcaaaagaagaggactctagtatagactatgatctaaacctcccagacacagtcacccacgaagattacgtgaccacaagattgtgatacttgaaggaggaagcgtttaccatacacatacgtattttccgtagtgctctgggtggg

SEQ ID NO: 192747 - DNA, 3226 bp, Homo sapiens
  Payload ID: 18049
  Gene Name: transient receptor potential cation channel, subfamily C, member 4 associated protein
  Uniprot ID: Q8TEL6
  ENST ID: ENST00000252015
  CDS Start-End: 91-2484
actgggggcgctgcggcgacccctccgccgccccgtagaaatctccgcggccccgaggccgcttgcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttacatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaagcctccattgtgttccctcctccaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 192748 - DNA, 3138 bp, Homo sapiens
  Payload ID: 18049
  Gene Name: transient receptor potential cation channel, subfamily C, member 4 associated protein
  Uniprot ID: Q8TEL6
  ENST ID: ENST00000451813
  CDS Start-End: 27-2396
gcttcctgtttgtccgacgaggagacatggcggcggcgccggtagcggctgggtctggagccggccgagggagacggtcggcagccacagtggcggcttggggcggatggggcggccggccgcggcctggtaacattctgctgcagctgcggcagggccagctgaccggccggggcctggtccgggcggtgcagttcactgagacttttttgacggagagggacaaacaatccaagtggagtggaattcctcagctgctcctcaagctgcacaccaccagccacctccacagtgactttgttgagtgtcaaaacatcctcaaggaaatttctcctcttctctccatggaggctatggcatttgttactgaagagaggaaacttacccaagaaaccacttatccaaatacttacatttttgacttgtttggaggtgttgatcttcttgtagaaattcttatgaggcctacgatctctatccggggacagaaactgaaaataagtgatgaaatgtccaaggactgcttgagtatcctgtataatacctgtgtctgtacagagggagttacaaagcgtttggcagaaaagaatgactttgtgatcttcctgtttacattgatgacaagtaagaagacattcttacaaacagcaaccctcattgaagatattttgggtgttaaaaaggaaatgatccgactagatgaagtccccaatctgagttccttagtatccaatttcgatcagcagcagctcgctaatttctgccggattctggctgtcaccatttcagagatggatacagggaatgatgacaagcacacgcttcttgccaaaaatgctcaacagaagaagagcttgagtttggggccttctgcagctgaaatcaatcaagcggcccttctcagcattcctggctttgttgagcggctttgcaaactggcgactcgaaaggtgtcagagtcaacgggcacagccagcttccttcaggagttggaagagtggtacacatggctagacaatgctttggtgctagatgccctgatgcgagtggccaatgaggagtcagagcacaatcaaggggcttctgaggagaatggcctgcctcacacgtcagccagaacccagctgccccagtcaatgaagattatgcatgagatcatgtacaaactggaagtgctctatgtcctctgcgtgctgctgatggggcgtcagcgaaaccaggttcacagaatgattgcagagttcaagctgatccctggacttaataatttgtttgacaaactgatttggaggaagcattcagcatctgcccttgtcctccatggtcacaaccagaactgtgactgtagcccggacatcaccttgaagatacagtttttgaggcttcttcagagcttcagtgaccaccacgagaacaagtacttgttactcaacaaccaggagctgaatgaactcagtgccatctctctcaaggccaacatccctgaggtggaagctgtcctcaacaccgacaggagtttggtgtgtgatgggaagaggggcttattaactcgtctgctgcaggtcatgaagaaggagccagcagagtcgtctttcaggttttggcaagctcgggctgtggagagtttcctccgagggaccacctcctatgcagaccagatgttcctgctgaagcgaggcctcttggagcacatcctttactgcattgtggacagcgagtgtaagtcaagggatgtgctccagagttactttgacctcctgggggagctgatgaagttcaacgttgatgcattcaagagattcaataaatatatcaacaccgatgcaaagttccaggtattcctgaagcagatcaacagctccctggtggactccaacatgctggtgcgctgtgtcactctgtccctggaccgatttgaaaaccaggtggatatgaaagttgccgaggtactgtctgaatgccgcctgctcgcctacatatcccaggtgcccacgcagatgtccttcctcttccgcctcatcaacatcatccacgtgcagacgctgacccaggagaacgtcagctgcctcaacaccagcctggtgatcctgatgctggcccgacggaaagagcggctgcccctgtacctgcggctgctgcagcggatggagcacagcaagaagtaccccggcttcctgctcaacaacttccacaacctgctgcgcttctggcagcagcactacctgcacaaggacaaggacagcacctgcctagagaacagctcctgcatcagcttctcatactggaaggagacagtgtccatcctgttgaacccggaccggcagtcaccctctgctctcgttagctacattgaggagccctacatggacatagacagggacttcactgaggagtgaccttgggccaggcctcgggaggctgctgggccagtgtgggtgagcgtgggtacgatgccacacgccctgccctgttcccgttcctccctgctgctctctgcctgccccaggtctttgggtacaggcttggtgggagggaagtcctagaagcccttggtccccctgggtctgagggccctaggtcatggagagcctcagtccccataatgaggacagggtaccatgcccacctttccttcagaaccctggggcccagggccacccagaggtaagaggacatttagcattagctctgtgtgagctcctgccggtttcttggctgtcagtcagtcccagagtggggaggaagatatgggtgacccccaccccccatctgtgagccaagcctcccttgtccctggcctttggacccaggcaaaggcttctgagccctgggcaggggtggtgggtaccagagaatgctgccttcccccaagcctgcccctctgcctcattttcctgtagctcctctggttctgtttgctcattggccgctgtgttcatccaagggggttctcccagaagtgaggggcctttccctccatcccttggggcacggggcagctgtgcctgccctgcctctgcctgaggcagccgctcctgcctgagcctggacatggggcccttccttgtgttgccaatttattaacagcaaataaaccaattaaatggagactattaaataactttattttaaaaatga

SEQ ID NO: 192749 - DNA, 5839 bp, Homo sapiens
  Payload ID: 18050
  Gene Name: transient receptor potential cation channel, subfamily C, member 5
  Uniprot ID: Q9UL62
  ENST ID: ENST00000262839
  CDS Start-End: 920-3841
accccacatcacaaccacgacgggttgtccgcagctcgcagccaccccaaagggaggaataaagaacaggagcagagggaagccgggcgcagaaagaagggaaaaggaagagctcagggttggacatttttggagacaggggtggggaggataaagggagcgtgcctccttgattttcccctccccacccctctttgcttttctctccccttctctgtatagcatattccagaaacggcagcagaaggggacagaaacctctagtgtagaaaagggttttggaggggtagccagcgctcccgccagccgctacctaacagctggagcttgagtgtgcgtgtaagagtgtgaatgcggctctctctctttttttctctctctctcccctctctctccatcccttccttcctccctccttctccctctccttcacactacagtgtcagctacccctgtcagtttccccgtgtcagtttcttccctagctcttattgtgtgtgactggctgcgtgaagggagtgggtgcgcttgaaggggctcaggttgggttagagagctgggagaacagggtagggacattggtagagcaaagagtttcagggcactggcgaaggtgaaaggtgaggagggccgatctgttacaggcaagtttggcaataactgagcatccaaaggggaagccaaggtaggagccagtacttgcgctcgtctttacaccccgcccctttccctgtgctcatccgcccacccacccatcagcctagaggccccgggctgtcccagtcggctgctgtttcgcgccgcaaaagaggagtccggcaaggcgccgcaccacgcatcctggccggtggacatccagacgacacagattttatccgaaaaaaccacttggctcaggatttctgcattgctatgaaccatggcccaactgtactacaaaaaggtcaactactcaccgtacagagaccgcatccccctgcaaattgtgagggctgagacagagctctctgcagaggagaaggccttcctcaatgctgtggagaagggggactatgccactgtgaagcaggcccttcaggaggctgagatctactataatgttaacatcaactgcatggaccccttgggccggagtgccctgctcattgccattgagaacgagaacctggagatcatggagctactgctgaaccacagcgtgtatgtgggtgatgcattgctctatgccatacgcaaggaagtggtgggcgctgtggagcttctgctcagctacaggcggcccagcggagagaagcaggtccccactctgatgatggacacgcagttctctgaattcacaccggacatcactcccatcatgctggctgcccacaccaacaactacgaaatcatcaaattgcttgtccaaaaacgggtcactatcccacggccccaccagatccgctgcaactgtgtggagtgtgtgtctagttcagaggtagacagcctgcgccactctcgctcccgactgaacatctataaggctctggcaagcccctcactcattgccttatcaagtgaggaccccatcctaactgccttccgtctgggctgggagctcaaggagctcagcaaggtggagaatgagttcaaggccgagtatgaggagctctctcagcagtgcaagctctttgccaaagacctgctggaccaagctcggagctccagggaactggagatcatcctcaaccatcgagatgaccacagtgaagagcttgaccctcagaagtaccatgacctggccaagttgaaggtggcaatcaaataccaccagaaagagtttgttgctcagcccaactgccaacagttgcttgccaccctgtggtatgatggcttccctggatggcggcggaaacactgggtagtcaagcttctaacctgcatgaccattgggttcctgtttcccatgctgtctatagcctacctgatctcacccaggagcaaccttgggctgttcatcaagaaaccctttatcaagtttatctgccacacagcatcctatttgaccttcctctttatgcttctcctggcttctcagcacattgtcaggacagaccttcatgtacaggggcctcccccaactgtcgtggaatggatgatattgccttgggttctaggtttcatttggggtgagattaaggaaatgtgggatggtggatttactgaatacatccatgactggtggaacctgatggattttgcaatgaactccctctacctggcaactatttccctgaagattgtggcctatgtcaagtataatggttctcgtccaagggaggaatgggaaatgtggcacccgactctgattgcggaagcactcttcgcaatatccaacattttaagttcgttgcgtctcatatccctgttcacagccaactcccacttaggacctctgcagatctctttgggacgcatgctgcttgatatcctcaaattcctctttatctactgcctggtactactagcttttgccaatggactgaaccagctttacttctattatgaaaccagagctatcgatgagcctaacaactgcaaggggatccgatgtgagaaacagaacaatgccttctccacgctctttgagactcttcagtcactcttctggtctgtatttggccttttaaatctatatgtcaccaatgtgaaagccagacacgaattcaccgagtttgtaggagctaccatgtttggaacatacaatgtcatctccctggtagtgctgctgaacatgctgattgctatgatgaacaactcctatcagcttattgccgatcatgctgatatcgagtggaagtttgcaaggacgaagctctggatgagttactttgatgaaggtggcaccttgccacctcctttcaacatcatccccagccccaagtcatttctataccttggtaactggttcaacaacaccttctgccccaaaagagaccctgacggtagacggagaaggcgcaacttgagaagtttcacagaacgcaatgctgacagcctgatacaaaatcaacattatcaggaagttatcaggaatttagtcaaaagatatgtggctgctatgataagaaattccaaaacacatgagggacttacagaagaaaattttaaggaattaaagcaagacatctccagctttcggtatgaagtgcttgacctcttgggaaatagaaaacatccaaggagcttttccactagcagcactgaactgtctcagagagacgataataatgatggcagtggtggggctcgggccaaatccaagagtgtctcttttaatttaggctgcaagaaaaagacttgccatgggccacctctcatcagaaccatgccaaggtccagtggtgcccaaggaaagtcaaaagctgagtcatcaagcaaacgctccttcatgggtccttctctcaagaaactgggtctcctattctccaaatttaatggtcatatgtctgaacccagttcagagccaatgtacacaatttctgatggaattgttcagcagcactgtatgtggcaggacatcagatattctcagatggagaaagggaaagcagaggcctgttctcaaagtgaaattaacctcagtgaggtagaattaggtgaagtccagggcgctgctcagagcagtgaatgccctctagcctgttccagctctcttcactgtgcatccagcatctgctcctcaaattctaaacttttagactcctcagaggatgtatttgaaacttggggagaggcttgtgacttgctcatgcacaaatggggtgatggacaggaagaacaagttacaactcgcctctaagtcaagccctaatcatctgttctggaactcaacagaaatctgtaatttccttgctctcagaggtgacacagaatatgattccctcactgcccctgccccccagaaaggagagtgaaactcttatttgcaccatcttttatagccacattctccatttttgttcttgttttattattactttcattattatttgcctttttaatacctatacacactaagtccatcttacaaccgactgaaggggtgttgcacctaatcatcagaggtgcagttgggtgcttaacctttttgctttgcttttctcacccatgcttccttgaagccccaggtgccactttgctggtcttgttgccgcacagattcctgaccatcctcagaatctcatgccattttcccgcagagctgagggatgtggtcagcagtccccaccagctatcagataaggcaaactaccctgcccatctttgttgccattcagtgctacgcgctgcccatgctgggtcaatgaacagcatcaaagggaggctgaagagatttcaaagaattgtcagcttgtggtttctgggtataagtggcttgtttcgttcttaaatactacaacttcttattgtgggggctattgagttttcttgtttcttaaagatgtgttagtttcctaatgtgtgccaatgaaatatttaccccatagtatatgtcatatctaataagttaggcgaattatttttctgtttgtgtgtttcagttaacttactacatttgaaaatttgatagtatcaaaattagtatttagaatttgtgctattttttaaaaacatctactacactctaaccaatagtcactacatctcatacattggcaagataaatagttgtcatatttgttgggtcctattctactgttgatagttttaattatcattgctatcaaataatttctaagataaaagcctgaatttgaaatatttttatcagaaaaatggcatattgctgaagtgtcaaaatatgagaaaagagcatcttcattttaattaactgctttataaaaatggcaactttaggtatagataacctaattcaggttgcagttttaatattcattgggggcagtggaattgcatgtgtaaattatgttagatatatatcataacaaccctagtggattcatggaattataaacgtgatccaaattctactgtcttccaagaaagctacatttatacatccaaacaaattcttttccacagcttaagagtacctcatcagaatacagtggttcaagttaaaaaataaagtccataatgcatatggtcatcattctagacctgataaccactgagaacctgctgagcaaggacggcttttaccaacattagcacaaaggtttcctcagtttagactctaacatatgacctgaaacaactctaggtctgagtcctagagattacataaatagtgtgtagcccagaaaagtaaaataggtgtcacgctgttttttttaatgtcaacaccaataggaatccatttagattaatgtatgtaatttctgataaaagtaagagaaatgaggaactttcgaactgcaaatatgcctccaaactagcttttgataagtgtggtttctgttatttgaatggattcccatctttgtctctagcctggagaagagcaaaatggagggggaggggccagaaataggaggaggttttgaagaataaagcctcatatccaggaaaaagtgatcaagtgaaaaagctgcatcaagacccatttggcaagaggttgtccgaaaataattccttgatcatatctgaagtggttatttactcaaatcaatttctcccctgcttcgctaagactgtcataaaatggccttgacatttaatcacaggttactttccagaaaggtttctaaagttacagattcagcttttcaaattgtcaaattcactttgaataataatagaacctgggctacattcctaactcatattaacagca

SEQ ID NO: 192750 - DNA, 4612 bp, Homo sapiens
  Payload ID: 18051
  Gene Name: transient receptor potential cation channel, subfamily C, member 6
  Uniprot ID: Q9Y210
  ENST ID: ENST00000344327
  CDS Start-End: 426-3221
gggatcttgacggagagtgcgggggatgaaggcgggagctgagggctggagagtctctgttgacatagtaactcttcagctccgtctcccttgctctccgctcttacgcttcgctaccaccagcggccccgcctgtgccctctctgcccgggcgccccagacgcatcctcgcggggtctcctcggcctgacctgctcaggtcaagatcctctttgcacccccttaagtggtgacttttccccgggccagtgggcgagccacttgcggcgggcgtctgcaccccctgcttcaccgtcgtcccctgggcaccggtctgcccaggtccagttcggccgctgacgcgaaccctccgcaccgggtccccgctggaactgcccactcggctcccccgggagcggggcccaggccagtcgggcgttcccgccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatgggcccaccttttaaacaagaaaacgttaaataacttgggccatcctatcatctggagccctagtatctaatttttttggtgattaaactccattgttcagggtaaaggctgtagataatgaggaaaattatgcccagttgtttggtgcttgttttataaactgctttcttggatataactaactcttgtgatgatgtcattgccatgtagtgtctgcctgaaaatgggtcccagcggacaggggctgacccacgttactccccatgcggtttttcctctgaagtttatttcaggttccttcttgcctgctctgtggatcccctgctggggactcccagctctgaaatttgggaaaaagtagcccatgggcctttagaatgctttaatcctttctttagaatgctgtttaaacaccatttaccctacttatccctcaatgcacatgattgataccgttcatacaaaatggtcttacatctatgtaaaattttctgattcatctatttgaaaacattacacttaacaatgaaaaaagtttttcctccactgaaccctggaaacatggtccagttttgtgtgtgtgcgtgtgtgtaaatgtgtacacacagacataaagtacttgccctagtttgtggctaatgtggacacacaaaagctctttatgttataaatttttattgtcactaaaaaattttactgtctaaataagtaccttttattggagaaaaatcaaaaccccaaacaaacactgtggttgtttggttccattatagcacaattttgtgccatttctgggagcatttacagatgaatccccacacttagccattgaatgtaaaggggaaaaataaggtgagaatttgtaaatacttatctgttattttcaatatgttctatccttctacccaaatatataaaacaggaatttgcattcatgtgcatttaccaagaggttgttgttgttacttactgatcatgtgaagtggtgtcttaaacaactaaaagcgatgaaggttcatatgtttactcaaagaccattggcattcagaggatgctggacattaactggaactgctacttccaattcaataatgggagatttcaaatgcaaatctttaacttcatcttaaagatgaaatggttgcagaaaatctgtttagctccaactttggcttaatttaaatcaaagaacatttatgtaaccagatcagaaaatacagctgaaaatttatattcagtgattttgtatttgtggatactacttatggaaaagttacttggtgatacataaagatcgattttcaaata

SEQ ID NO: 192751 - DNA, 2448 bp, Homo sapiens
  Payload ID: 18051
  Gene Name: transient receptor potential cation channel, subfamily C, member 6
  Uniprot ID: Q9Y210
  ENST ID: ENST00000348423
  CDS Start-End: 1-2448
atgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataa

SEQ ID NO: 192752 - DNA, 2631 bp, Homo sapiens
  Payload ID: 18051
  Gene Name: transient receptor potential cation channel, subfamily C, member 6
  Uniprot ID: Q9Y210
  ENST ID: ENST00000360497
  CDS Start-End: 1-2631
atgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaaatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaataggcatgatatgggctgaatgtaaagaaatctggactcagggccccaaggaatatttgtttgagttgtggaacatgcttgattttggtatgttagcaattttcgcagcatcattcattgcgagattcatggcattttggcatgcttccaaagcccagagcatcattgacgcaaatgatactttgaaggacttgacgaaagtaacattgggagacaatgtgaaatactacaatttggccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataa

SEQ ID NO: 192753 - DNA, 2648 bp, Homo sapiens
  Payload ID: 18051
  Gene Name: transient receptor potential cation channel, subfamily C, member 6
  ENST ID: ENST00000532133
  CDS Start-End: 4-2565
gccatgagccagagcccggcgttcgggccccggaggggcagttctccccggggcgctgccggagccgctgcgcggcgcaacgagagccaggactatctgctcatggactcggagctgggagaagacggctgcccgcaagccccgctgccttgctacggctactacccctgcttccggggatctgacaacagactggctcaccggcggcagacagttctccgtgagaaggggagaaggttagctaatcgaggaccagcatacatgtttagtgatcgctccacaagcctatctatagaggaggaacgctttttggatgcagctgaatatggtaacatcccagtggtgcggaagatgttagaagaatgccactcactcaacgttaactgtgtggattacatgggccagaatgccctacagttggcagtggccaatgagcatctggaaattacagaacttcttctcaagaaagaaaacctctctcgagttggggatgctttgcttctagctattagtaaaggttatgttcggattgtggaagcaattctcagtcatccggcttttgctgaaggcaagaggttagcaaccagccctagccagtctgaactccagcaagatgatttttatgcctatgatgaagatgggacacggttctcccatgatgtgactccaatcattctggctgcccactgccaggaatatgaaattgtgcataccctcctgcggaagggtgctaggattgaacggcctcatgattatttctgcaagtgcaatgactgcaaccagaaacagaagcatgactcgtttagccactccagatctaggattaatgcctataaaggcctggcaagtccggcttacctgtcattgtctagtgaagatccagtcatgacggctttagaacttagcaatgaactggcagttctggccaatattgagaaagagttcaagaatgactacaaaaaactgtcaatgcagtgcaaagactttgttgttggactccttgatctgtgcagaaacactgaagaagtcgaggccattctgaatggggatgttgaaacgctccagagtggtgatcacggtcgcccaaatctcagccgtttaaaacttgccattaaatatgaagtaaaaaaatttgtagctcatccaaactgccaacagcaacttctctccatttggtatgagaatctttctggtttacgacagcagacaatggcggtcaagttccttgtggtccttgctgttgccattggactgcccttcctggctctcatttactggtttgctccatgcagcaagatggggaagataatgcgtggaccattcatgaagtttgtagcacacgcagcctccttcaccatttttctgggactgctagtcatgaatgcagctgacagatttgaaggcacaaaactccttcctaatgaaaccagcacagataatgcaaaacagctgttcaggatgaaaacatcctgcttctcatggatggagatgctcattatatcctgggtaatagccaggataaagtgggacccctctgatcctcaaataatatctgaaggtctttatgcaattgctgtagttttaagtttctctaggatagcttatattttaccagcaaatgaaagctttggacctctgcagatatcacttggaagaacagtcaaagacatcttcaagttcatggtcatattcattatggtgtttgtggcctttatgattggaatgttcaatctctactcctactacattggtgcaaaacaaaatgaagccttcacaacagttgaagagagttttaagacactgttctgggctatatttggactttctgaagtgaaatcagtggtcatcaactataaccacaaattcattgaaaacattggttacgttctttatggagtctataatgttacgatggtcattgttttgctaaatatgttaattgccatgatcaacagttcattccaggaaattgaggatgacgctgatgtggagtggaaatttgcaagggccaaactctggttttcctactttgaggagggcagaacacttcctgtacccttcaatctggtgccgagtccaaagtccctgttttatctcttactgaagcttaaaaaatggatttctgagctgttccagggccataaaaaaggtttccaggaagatgcagagatgaacaagataaatgaagaaaagaaacttggaattttaggaagtcatgaagacctttcaaaattatcacttgacaaaaaacaggttgggcacaataaacaaccaagtataaggagctcagaagatttccatctaaatagtttcaataatcctccaagacaatatcagaaaataatgaaaaggctcattaaaagatatgtactgcaggcccagatagataaggagagtgatgaagtgaacgaaggggaactgaaggaaattaagcaggacatctcaagtctccgctatgaactccttgaagaaaaatctcagaatacagaagacctagcagaacttattagagaacttggagagaaattatccatggaaccaaatcaagaggaaaccaatagataatgcgaagacttccttagaaattcatatttatttgtccacttgaagccatattattttctgatttattttcttaagtgccaatg

SEQ ID NO: 192754 - DNA, 2241 bp, Homo sapiens
  Payload ID: 18052
  Gene Name: transient receptor potential cation channel, subfamily C, member 7
  Uniprot ID: Q9HCX4
  ENST ID: ENST00000352189
  CDS Start-End: 1-2241
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 192755 - DNA, 2406 bp, Homo sapiens
  Payload ID: 18052
  Gene Name: transient receptor potential cation channel, subfamily C, member 7
  Uniprot ID: Q9HCX4
  ENST ID: ENST00000378459
  CDS Start-End: 1-2406
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 192756 - DNA, 2605 bp, Homo sapiens
  Payload ID: 18052
  Gene Name: transient receptor potential cation channel, subfamily C, member 7
  ENST ID: ENST00000503275
  CDS Start-End: 1-1143
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaaggtacagactgcttaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 192757 - DNA, 2424 bp, Homo sapiens
  Payload ID: 18052
  Gene Name: transient receptor potential cation channel, subfamily C, member 7
  ENST ID: ENST00000502753
  CDS Start-End: 1-2424
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 192758 - DNA, 2987 bp, Homo sapiens
  Payload ID: 18052
  Gene Name: transient receptor potential cation channel, subfamily C, member 7
  Uniprot ID: Q9HCX4
  ENST ID: ENST00000513104
  CDS Start-End: 284-2872
acagatgcttctccgtcatgttctctgggaaatttccccccgattaggaaaaggacggtaacacggttctgcctcggaaggcgagtttttaccactgcaacacaaagaacagaggagcgcgctttcacatcgttgcaacttaactcacttgaccagctctatacttcagcaccacggagagcggtacatccttggctaccacccatggggagccagcttctggcgactcaacaccggattccggtcatctagaggaggaacaagcctgcgtattacaccctcaatgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaagaacgattacaggaagttatctatgcaatgcaaggattttgtagtgggcgtgctggacctgtgccgagacacagaagaggtggaagcaattttaaacggtgatgtgaacttccaagtctggtccgaccaccaccgtccaagtctgagccggatcaaactcgccattaaatatgaagtcaagaagttcgttgctcatcctaactgtcagcagcaattgcttaccatgtggtatgaaaatctctcaggcttacgtcaacagtctatcgctgtgaaattcctggctgtctttggagtctccataggcctcccttttctcgccatagcctattggattgctccgtgcagcaagctaggacgaaccctgaggagccctttcatgaagtttgtagctcatgcagtttcttttacaatcttcttgggattattagttgtgaatgcatctgaccgatttgaaggtgttaaaaccctgccaaacgaaaccttcacagactacccaaaacaaatcttcagagtgaaaaccacacagttctcctggacagaaatgctcattatgaagtgggtcttaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttagcagcccacatcggcgtctgtgacttctaccagcattccaaggccaggttggatgccctcgcccccatccttggtggggaggggtccccagcccactcctctaggacacgaagggg

SEQ ID NO: 192759 - DNA, 2024 bp, Homo sapiens
  Payload ID: 18052
  Gene Name: transient receptor potential cation channel, subfamily C, member 7
  ENST ID: ENST00000514963
  CDS Start-End: 1-786
atgttgaggaacagcaccttcaaaaacatgcagcgccggcacacaacgctgagggagaagggccgtcgccaggccatccggggtcccgcctacatgttcaacgagaagggcaccagtctgacgcccgaggaggagcgcttcctggactcggctgagtatggcaacatcccggtggtccggaaaatgctggaggagtccaagacccttaacttcaactgtgtggactacatggggcagaacgctctgcagctggccgtgggcaacgagcacctagaggtcacggagctgctgctgaagaaggagaacctggcacgggtgggggacgcgctgctgctggccatcagcaagggctatgtgcgcatcgtggaggccatcctcaaccacccggccttcgcgcagggccagcgcctgacgctcagcccgctggaacaggagctgcgcgacgacgacttctatgcctacgacgaggacggcacgcgcttctcccacgacatcacgcccatcatcctggcggcgcactgccaggagtatgagatcgtgcacatcctgctgctcaagggcgcccgcatcgagcggccccacgactacttctgcaagtgcaatgagtgcaccgagaaacagcggaaagactccttcagccactcgcgctcgcgcatgaacgcctacaaaggactggcgagtgctgcctacttgtccctgtccagcgaagaccctgtcctcaccgccctggagctcagcaacgagttagccagactagccaacattgagactgaatttaaggaatgatttggtccgaatgcaaggaaatctgggaggaggggccacgggagtacgtgctgcacttgtggaacctgctagatttcgggatgctgtccatcttcgtggcctccttcacagcacgcttcatggccttcctgaaggccacggaggcacagctgtacgtggaccagcacgtgcaggacgacacgctgcacaatgtctcgcttccgccggaagtggcatacttcacctacgccagggacaagtggtggccttcagaccctcagatcatatcggaagggctctacgcgatagccgtcgtgctgagcttctctcgcattgcatacattctgccagccaacgagagttttgggcccctgcagatctcgctagggagaactgtgaaagatatcttcaagttcatggtcattttcatcatggtatttgtggccttcatgattgggatgttcaacctgtactcttactaccgaggtgccaaatacaacccagcgtttacaacggttgaagaaagttttaaaactttgttttggtccatattcggcttatctgaagtaatctcagtggtgctgaaatacgaccacaaattcatcgagaacattggctacgttctctacggcgtttataacgtcaccatggtggtagtgttgctcaacatgctaatagccatgataaacaactcctatcaggaaattgaggaggatgcagatgtggaatggaagttcgcccgagcaaaactctggctgtcttactttgatgaaggaagaactctacctgctccttttaatctagtgccaagtcctaaatcattttattatctcataatgagaatcaagatgtgcctcataaaactctgcaaatctaaggccaaaagctgtgaaaatgaccttgaaatgggcatgctgaattccaaattcaagaagactcgctaccaggctggcatgaggaattctgaaaatctgacagcaaataacactttgagcaagcccaccagataccagaaaatcatgaaacggctcataaaaagatacgtcctgaaagcccaggtggacagagaaaatgacgaagtcaatgaaggcgagctgaaggaaatcaagcaagatatctccagcctgcgctatgagcttcttgaggaaaaatctcaagctactggtgagctggcagacctgattcaacaactcagcgagaagtttggaaagaacttaaacaaagaccacctgagggtgaacaagggcaaagacatttag

SEQ ID NO: 192760 - DNA, 5514 bp, Homo sapiens
  Payload ID: 18053
  Gene Name: transient receptor potential cation channel, subfamily M, member 1
  Uniprot ID: Q7Z4N2
  ENST ID: ENST00000256552
  CDS Start-End: 149-5026
gccctggccaaggaggaggctgaaagagcctgagctgtgccctctccattccactgctgtggcaggttctagaagatttctgaggactcagcagtaacttgcagtgctggactgaggctatttccttatatcaactttttgaaaactcatgggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaa

SEQ ID NO: 192761 - DNA, 5687 bp, Homo sapiens
  Payload ID: 18053
  Gene Name: transient receptor potential cation channel, subfamily M, member 1
  Uniprot ID: Q7Z4N2
  ENST ID: ENST00000397795
  CDS Start-End: 115-4926
ggaggctgaaagagcctgagctgtgccctctccattccactgctgtggcagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattgtgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 192762 - DNA, 6004 bp, Homo sapiens
  Payload ID: 18053
  Gene Name: transient receptor potential cation channel, subfamily M, member 1
  Uniprot ID: Q7Z4N2
  ENST ID: ENST00000542188
  CDS Start-End: 315-5243
ctaaatctcttccctctaaaccttttggggatggagggattaagcctgattacagatgttgggggtggtagcaggagtcgggcaggaggggccaccaaaagccagcacatgctcctcctaggctgaaccagcctccggccggcctcgccccaggatctcggccccctcgcccagtgcgtggggctgccgccgagtgtggggctgccgccgagtgtgtggctccgctcctgcccacccagggagggcagcccctgtgccactggcctggccacccgagggagtcagcagggtggctcacaggctcactgagagagatgagctccttcaagcggggctcgctcaagagctccacatcagggtcgcagaagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattgtgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 192763 - DNA, 4282 bp, Homo sapiens
  Payload ID: 18053
  Gene Name: transient receptor potential cation channel, subfamily M, member 1
  ENST ID: ENST00000558445
  CDS Start-End: 113-4282
ctccttcaagcggggctcgctcaagagctccacatcagggtcgcagaagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 192764 - DNA, 4581 bp, Homo sapiens
  Payload ID: 18053
  Gene Name: transient receptor potential cation channel, subfamily M, member 1
  ENST ID: ENST00000558768
  CDS Start-End: 1-4581
tatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaaaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctag

SEQ ID NO: 192765 - DNA, 1627 bp, Homo sapiens
  Payload ID: 18053
  Gene Name: transient receptor potential cation channel, subfamily M, member 1
  ENST ID: ENST00000559177
  CDS Start-End: 113-1627
ctccttcaagcggggctcgctcaagagctccacatcagggtcgcagaagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacagctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacag

SEQ ID NO: 192766 - DNA, 4454 bp, Homo sapiens
  Payload ID: 18053
  Gene Name: transient receptor potential cation channel, subfamily M, member 1
  ENST ID: ENST00000560801
  CDS Start-End: 1-690
tatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtaggatttctgacgcgcgaggaagggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacggagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaatgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgtctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctag

SEQ ID NO: 192767 - DNA, 1002 bp, Homo sapiens
  Payload ID: 18053
  Gene Name: transient receptor potential cation channel, subfamily M, member 1
  Uniprot ID: Q7Z4N2
  ENST ID: ENST00000559179
  CDS Start-End: 135-545
ctccctgccctggccaaggaggaggctgaaagagcctgagctgtgccctctccattccactgctgtggcagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatggtgagaaaggcattcagacatggtgccactaggatcacagctttcattggcggccagtctcccagccccaaactgcagatacctggtcttcttcatggctgtggctcaatcttcctagatatttcattgaaaaaccaagagatatatctgtgcacatggcttttagccatgaggcttggaaactggacaccactgtaaagaacatctagtgtcccgtaaatccataccaaagctctgaatccacaaaccaggctctggcccaaccctgcaaacacactccattgctccatcttcagtaaaggaagacaaattcatttttctaataactgtggacctgcagcccccttagatgtgttgagagtctttggaaatattttcctctgaggtctgtccacagcttccctgggcctgcgctcagctggcccgagaaggaccaaggtccctcacatttgcatgtaaacagggagtgccctctgcccttccagtgagccctgccagcgtgggggaggcttcagctctgtgatccgttccagctcactctgaattacactcctacatgcccagtcacagactttttgcaatttcattttatttcactggcccaacatcattgttaaaataaaatttagctgtgttccaaatgctgcaatataca

SEQ ID NO: 192768 - DNA, 1649 bp, Homo sapiens
  Payload ID: 18053
  Gene Name: transient receptor potential cation channel, subfamily M, member 1
  Uniprot ID: Q7Z4N2
  ENST ID: ENST00000560658
  CDS Start-End: 114-1016
gaggctgaaagagcctgagctgtgccctctccattccactgctgtggcagggtcagaaatcttggatagagaaaaccttttgcaaacgggaatgtatctttgtaattcctagcatgaaagactctaacaggtgttgctgtggccagttcaccaaccagcatatcccccctctgccaagtgcaacacccagcaaaaatgaagaggaaagcaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtaggatttctgacgcgcgaggaagggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccggtgaaactgttttttttcgattcatatcattgatcttgactttgtacaagtgacctattagtatgttctcccttgtgacatggaattcaggaaattatgtggggtttctgatgatatgatatgtaatctattaggctcattagaagatgtcactgtttaacttcaaagaaccaacaagaagtaattccacattcaaaccagtactcctgaagaaattaatcaccaaatattttatcgttgctgatgaaagtgggtttttacctttttaaagaaaaagaagaagaaataaaatagcttattaaaatttaa

SEQ ID NO: 192769 - DNA, 5706 bp, Homo sapiens
  Payload ID: 18053
  Gene Name: transient receptor potential cation channel, subfamily M, member 1
  ENST ID: ENST00000617515
  CDS Start-End: 134-4945
tccctgccctggccaaggaggaggctgaaagagcctgagctgtgccctctccattccactgctgtggcagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacagagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 192770 - DNA, 5792 bp, Homo sapiens
  Payload ID: 18053
  Gene Name: transient receptor potential cation channel, subfamily M, member 1
  ENST ID: ENST00000615583
  CDS Start-End: 154-5031
tccctgccctggccaaggaggaggctgaaagagcctgagctgtgccctctccattccactgctgtggcaggttctagaagatttctgaggactcagcagtaacttgcagtgctggactgaggctatttccttatatcaactttttgaaaactcatgggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacagagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 192771 - DNA, 6004 bp, Homo sapiens
  Payload ID: 18053
  Gene Name: transient receptor potential cation channel, subfamily M, member 1
  ENST ID: ENST00000611448
  CDS Start-End: 315-5243
ctaaatctcttccctctaaaccttttggggatggagggattaagcctgattacagatgttgggggtggtagcaggagtcgggcaggaggggccaccaaaagccagcacatgctcctcctaggctgaaccagcctccggccggcctcgccccaggatctcggccccctcgcccagtgcgtggggctgccgccgagtgtggggctgccgccgagtgtgtggctccgctcctgcccacccagggagggcagcccctgtgccactggcctggccacccgagggagtcagcagggtggctcacaggctcactgagagagatgagctccttcaagcggggctcgctcaagagctccacatcagggtcgcagaagggtcagaaatcttggatagagaaaaccttttgcaaacgggaatgtatctttgtaattcctagcacgaaagactctaacaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacagagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 192772 - DNA, 4454 bp, Homo sapiens
  Payload ID: 18053
  Gene Name: transient receptor potential cation channel, subfamily M, member 1
  ENST ID: ENST00000621076
  CDS Start-End: 1-690
tatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcgggtaggatttctgacgcgcgaggaagggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacagagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgtctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctag

SEQ ID NO: 192773 - DNA, 5573 bp, Homo sapiens
  Payload ID: 18053
  Gene Name: transient receptor potential cation channel, subfamily M, member 1
  ENST ID: ENST00000618210
  CDS Start-End: 1-4812
atcaagacatcaaaaaggtgttgctgtggccagttcaccaaccagcatatcccccctctgccaagtgcaacacccagcaaaaatgaagaggaaaacaaacaggtggagactcagcctgagaaatggtctgttgccaagcacacccagagctacccaacagattcctatggagttcttgaattccagggtggcggatattccaataaagccatgtatatccgtgtatcctatgacaccaagccagactcactgctccatctcatggtgaaagattggcagctggaactccccaagctcttaatatctgtgcatggaggcctccagaactttgagatgcagcccaagctgaaacaagtctttgggaaaggcctgatcaaggctgctatgaccaccggggcctggatcttcaccgggggtgtcagcacaggtgttatcagccacgtaggggatgccttgaaagaccactcctccaagtccagaggccgggtttgtgctataggaattgctccatggggcatcgtggagaataaggaagacctggttggaaaggatgtaacaagagtgtaccagaccatgtccaaccctctaagtaagctctctgtgctcaacaactcccacacccacttcatcctggctgacaatggcaccctgggcaagtatggcgccgaggtgaagctgcgaaggctgctggaaaagcacatctccctgcagaagatcaacacaagactggggcagggcgtgcccctcgtgggtctcgtggtggaggggggccctaacgtggtgtccatcgtcttggaatacctgcaagaagagcctcccatccctgtggtgatttgtgatggcagcggacgtgcctcggacatcctgtcctttgcgcacaagtactgtgaagaaggcggaataataaatgagtccctcagggagcagcttctagttaccattcagaaaacatttaattataataaggcacaatcacatcagctgtttgcaattataatggagtgcatgaagaagaaagaactcgtcactgtgttcagaatgggttctgagggccagcaggacatcgagatggcaattttaactgccctgctgaaaggaacaaacgtatctgctccagatcagctgagcttggcactggcttggaaccgcgtggacatagcacgaagccagatctttgtctttgggccccactggccgcccctgggaagcctggcacccccgacggacagcaaagccacagagaaggagaagaagccacccatggccaccaccaagggaggaagaggaaaagggaaaggcaagaagaaagggaaagtgaaagaggaagtggaggaagaaactgacccccggaagatagagctgctgaactgggtgaatgctttggagcaagcgatgctagatgctttagtcttagatcgtgtcgactttgtgaagctcctgattgaaaacggagtgaacatgcaacactttctgaccattccgaggctggaggagctttataacacaagactgggtccaccaaacacacttcatctgctggtgagggatgtgaaaaagagcaaccttccgcctgattaccacatcagcctcatagacatcgggctcgtgctggagtacctcatgggaggagcctaccgctgcaactacactcggaaaaactttcggaccctttacaacaacttgtttggaccaaagaggcctaaagctcttaaacttctgggaatggaagatgatgagcctccagctaaagggaagaaaaagaaaaagaagaaaaaggaggaagagatcgacattgatgtggacgaccctgccgtgagtcggttccagtatcccttccacgagctgatggtgtgggcagtgctgatgaaacgccagaaaatggcagtgttcctctggcagcgaggggaagagagcatggccaaggccctggtggcctgcaagctctacaaggccatggcccacgagtcctccgagagtgatctggtggatgacatctcccaggacttggataacaattccaaagacttcggccagcttgctttggagttattagaccagtcctataagcatgacgagcagatcgctatgaaactcctgacctacgagctgaaaaactggagcaactcgacctgcctcaaactggccgtggcagccaaacaccgggacttcattgctcacacctgcagccagatgctgctgaccgatatgtggatgggaagactgcggatgcggaagaaccccggcctgaaggttatcatggggattcttctaccccccaccatcttgtttttggaatttcgcacatatgatgatttctcgtatcaaacatccaaggaaaacgaggatggcaaagaaaaagaagaggaaaatacggatgcaaatgcagatgctggctcaagaaagggggatgaggagaacgagcacaaaaaacagagaagtattcccatcggaacaaagatctgtgaattctataacgcgcccattgtcaagttctggttttacacaatatcatacttgggctacctgctgctgtttaactacgtcatcctggtgcggatggatggctggccgtccctccaggagtggatcgtcatctcctacatcgtgagcctggcgttagagaagatacgagagatcctcatgtcagaaccaggcaaactcagccagaaaatcaaagtttggcttcaggagtactggaacatcacagatctcgtggccatttccacattcatgattggagcaattcttcgcctacagaaccagccctacatgggctatggccgggtgatctactgtgtggatatcatcttctggtacatccgtgtcctggacatctttggtgtcaacaagtatctggggccatacgtgatgatgattggaaagatgatgatcgacatgctgtactttgtggtcatcatgctggtcgtgctcatgagtttcggagtagcccgtcaagccattctgcatccagaggagaagccctcttggaaactggcccgaaacatcttctacatgccctactggatgatctatggagaggtgtttgcagaccagatagacctctacgccatggaaattaatcctccttgtggtgagaacctatatgatgaggagggcaagcggcttcctccctgtatccccggcgcctggctcactccagcactcatggcgtgctatctactggtcgccaacatcctgctggtgaacctgctgattgctgtgttcaacaataccttctttgaagtaaaatcaatatccaaccaggtgtggaagttccagcgatatcagctgattatgacatttcatgacaggccagtcctgcccccaccgatgatcattttaagccacatctacatcatcattatgcgtctcagcggccgctgcaggaaaaagagagaaggggaccaagaggaacgggatcgtggattgaagctcttccttagcgacgaggagctaaagaggctgcatgagttcgaggagcagtgcgtgcaggagcacttccgggagaaggaggatgagcagcagtcgtccagcgacgagcgcatccgggtcacttctgaaagagttgaaaatatgtcaatgaggttggaagaaatcaatgaaagagaaacttttatgaaaacttccctgcagactgttgaccttcgacttgctcagctagaagaattatctaacagaatggtgaatgctcttgaaaatcttgcgggaatcgacaggtctgacctgatccaggcacggtcccgggcttcttctgaatgtgaggcaacgtatcttctccggcaaagcagcatcaatagcgctgatggctacagcttgtatcgatatcattttaacggagaagagttattatttgaggatacatctctctccacgtcaccagggacaggagtcaggaaaaaaacctgttccttccgtataaaggaagagaaggacgtgaaaacgcacctagtcccagaatgtcagaacagtcttcacctttcactgggcacaagcacatcagcaaccccagatggcagtcaccttgcagtagatgacttaaagaacgctgaagagtcaaaattaggtccagatattgggatttcaaaggaagatgatgaaagacagacagactctaaaaaagaagaaactatttccccaagtttaaataaaacagatgtgatacatggacaggacaaatcagatgttcaaaacactcagctaacagtggaaacgacaaatatagaaggcactatttcctatcccctggaagaaaccaaaattacacgctatttccccgatgaaacgatcaatgcttgtaaaacaatgaagtccagaagcttcgtctattcccggggaagaaagctggtcggtggggttaaccaggatgtagagtacagttcaatcacggaccagcaattgacgacggaatggcaatgccaagttcaaaagatcacgcgctctcatagcacagatattccttacattgtgtcggaagctgcagtgcaagctgagcataaagagcagtttgcagatatgcaagatgaacaccatgtcgctgaagcaattcctcgaatccctcgcttgtccctaaccattactgacagaaatgggatggaaaacttactgtctgtgaagccagatcaaactttgggattcccatctctcaggtcaaaaagtttacatggacatcctaggaatgtgaaatccattcagggaaagttagacagatctggacatgccagtagtgtaagcagcttagtaattgtgtctggaatgacagcagaagaaaaaaaggttaagaaagagaaagcttccacagaaactgaatgctagtctgttttgtttctttaatttttttttttaacagtcagaaccactaatgggtgtcatcttggccatctaaacatcatcaatttctaaaaacattttccttaaaaaattttggaaattcagacttgatttacaatttaatgcactaaaagtagtattttgttagcatatgttagtaggcttagttttttcagttgcagtagtatcaaatgaaagtgatgatactgtaacgaagataaattggctaatcagtatacaagattatacaatctctttattactgagggccaccaaatagcctaggaagtgccctcgagcactgaagtcaccattaggtcacttaagaagtaagcaactagctgggcacagtggctcatgcctgtaatcctagcactttgggaggccaaggcagaaagatagcttgagtccaggagtttgagaccagcctgggcaacatagtgataccccatctcttaaaaaaaaaaaaaaaagtaagcaactgtgtaagaaagagaaactaaagagaaagcaaacatgaaaaaagggaggggtggaaagaagaaaaataaaattatgaggcacaataagtgggaaggagccacaaatatgtttttatggggtctttgttttctgttttaatgttttattttaaactacacaatgggaaaaaaagtacacaattatatcaaacatcatactctaataatttagggtgacctagagttttgttaatgtgcaaaaataaagtatccaatatgcatttt

SEQ ID NO: 192774 - DNA, 5627 bp, Homo sapiens
  Payload ID: 18054
  Gene Name: transient receptor potential cation channel, subfamily M, member 2
  Uniprot ID: O94759
  ENST ID: ENST00000300481
  CDS Start-End: 14-4363
tgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 192775 - DNA, 5989 bp, Homo sapiens
  Payload ID: 18054
  Gene Name: transient receptor potential cation channel, subfamily M, member 2
  Uniprot ID: O94759
  ENST ID: ENST00000300482
  CDS Start-End: 214-4725
tgcaccgggcacgcggcgcacgctcgggcgagatgtggatggccccgcggggccagggcggcggtgctgcgcggggacgcgggtgacgccggggcgcgggcggctccgagcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 192776 - DNA, 6221 bp, Homo sapiens
  Payload ID: 18054
  Gene Name: transient receptor potential cation channel, subfamily M, member 2
  Uniprot ID: O94759
  ENST ID: ENST00000397928
  CDS Start-End: 446-4957
tgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtat

SEQ ID NO: 192777 - DNA, 5216 bp, Homo sapiens
  Payload ID: 18054
  Gene Name: transient receptor potential cation channel, subfamily M, member 2
  ENST ID: ENST00000397932
  CDS Start-End: 14-4675
tgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacgggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtgtggccatcaagatccccatcgtgtgcgtggtgctggagggcggcccgggcacgttgcacaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaagatccaagatatcgtccggaggcggcagctgctgactgtcttccgggaaggcaaggatggtcagcaggacgtggatgtggccatcttgcaggccttgctgaaagcctcacggagccaagaccactttggccacgagaactgggaccaccagctgaaactggcagtggcatggaatcgcgtggacattgcccgcagtgagatcttcatggatgagtggcagtggaagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcagggagtgagcctccggtccctctacaagcgttcctcaggccatgtgaccttcaccatggaccccatccgtgaccttctcatttgggccattgtccagaaccgtcgggagctggcaggaatcatctgggctcagagccaggactgcatcgcagcggccttggcctgcagcaagatcctgaaggaactgtccaaggaggaggaggacacggacagctcggaggagatgctggcgctggcggaggagtatgagcacagagccatcggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggccttcctgaccaaggtgtggtggggccagctctccgtggacaatgggctgtggcgtgtgaccctgtgcatgctggccttcccgctgctcctcaccggcctcatctccttcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcagctcttctatgaccctgacgagtgcgggctgatgaagaaggcagccttgtacttcagtgacttctggaataagctggacgtcggcgcaatcttgctcttcgtggcagggctgacctgcaggctcatcccggcgacgctgtaccccgggcgcgtcatcctctctctggacttcatcctgttctgcctccggctcatgcacatttttaccatcagtaagacgctggggcccaagatcatcattgtgaagcggatgatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaactacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcaagaacaagctggagaagaacgaggaggcggccctgctatcctgggagatctacctgaaggagaactacctccagaaccgacagttccagcaaaagcagcggcccgagcagaagatcgaggacatcagcaataaggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcagggttgacgccatggtggacctgctggacctggacccactgaagaggtcgggctccatggagcagaggttggcctccctggaggagcaggtggcccagacagcccaagccctgcactggatcgtgaggacgctgcgggccagcggcttcagctcggaggcggacgtccccactctggcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagacaccctggagccactgtccacgatccagtacaacgtggtggatggcctgagggaccgccggagcttccacgggccgtacacagtgcaggccgggttgcccctgaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataa

SEQ ID NO: 192778 - DNA, 582 bp, Homo sapiens
  Payload ID: 18054
  Gene Name: transient receptor potential cation channel, subfamily M, member 2
  ENST ID: ENST00000431901
  CDS Start-End: 152-582
gcgcgagcccgggtgcggggactgaggcggccgtcccgggagcttgtgaagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaagcaagaaagcctcagttcgtggattcctgaaaacatcaagaagaaagaatgcgtgtattttgtggaaagttccaaactgtctgatgctgggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaagtacgtccg

SEQ ID NO: 192779 - DNA, 1669 bp, Homo sapiens
  Payload ID: 18054
  Gene Name: transient receptor potential cation channel, subfamily M, member 2
  ENST ID: ENST00000621064
  CDS Start-End: 99-842
agccctgcactggatcgtgaggacgctgcgggccagcggcttcagctcggaggcggacgtccccactctggcctcccagaaggccgcggaggagccggatgctgagccgggagcaggaagaagacggaggagccgggcgacagtaccacgtgaatgcccggcacctcctctaccccaactgccctgtcacgcgcttccccgtgcccaacgagaaggtgccctgggagacggagttcctgatctatgacccacccttttacacggcagagaggaaggacgcggccgccatggaccccatgggagagaaccccatgggccgcacaggactgcgtgggcgcgggagcctcagctgcttcggacccaaccacacgctgtaccccatggtcacgcggtggaggcggaacgaggatggagccatctgcaggaagagcataaagaagatgctggaagtgctggtggtgaagctccctctctccgagcactgggccctgcctgggggctcccgggagccaggggagatgctacctcggaagctgaagcggatcctccggcaggagcactggccgtcttttgaaaacttgctgaagtgcggcatggaggtgtacaaaggctacatggatgacccgaggaacacggacaatgcctggatcgagacggtggccgtcagcgtccacttccaggaccagaatgacgtggagctgaacaggctgaactctaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggc

SEQ ID NO: 192780 - DNA, 5145 bp, Homo sapiens
  Payload ID: 18055
  Gene Name: transient receptor potential cation channel, subfamily M, member 3
  ENST ID: ENST00000357533
  CDS Start-End: 1-5136
atggggaagaagtggagggatgcggcggaaatggagcggggctgctccgaccgcgaggacaacgcggagagccgcagacgcagccggagcgccagccggggcaggtttgccgagtcgtggaaaaggttaagttccaagcaggggtccaccaaacgctcgggactcccgtcgcagcagacgccggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttctta

SEQ ID NO: 192781 - DNA, 4710 bp, Homo sapiens
  Payload ID: 18055
  Gene Name: transient receptor potential cation channel, subfamily M, member 3
  ENST ID: ENST00000358082
  CDS Start-End: 1-4710
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 192782 - DNA, 5966 bp, Homo sapiens
  Payload ID: 18055
  Gene Name: transient receptor potential cation channel, subfamily M, member 3
  ENST ID: ENST00000360823
  CDS Start-End: 356-5065
agctgcagcaaaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 192783 - DNA, 1260 bp, Homo sapiens
  Payload ID: 18055
  Gene Name: transient receptor potential cation channel, subfamily M, member 3
  Uniprot ID: Q9HCF6
  ENST ID: ENST00000361823
  CDS Start-End: 327-1019
tgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcgggtaggtaactttccaggccccatggaagaaccctaaagcctgtttggaaacgagggtatgagtggattatgttttcagtagctcaaccaagacctcaaatcaaaacaagctatgaacaaattgtctaaaaaatgtctgtcatgggagggctgtggtgaagaacagagaaacatattctaaatgtcctgtgaagtgggaaattctatgaaagctacacggataataaaaagggtgaggaaaagaga

SEQ ID NO: 192784 - DNA, 554 bp, Homo sapiens
  Payload ID: 18055
  Gene Name: transient receptor potential cation channel, subfamily M, member 3
  ENST ID: ENST00000377097
  CDS Start-End: 129-500
atgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgtaagtcctgagtgctgtcgctttccatgacttctcctagaggggatatcagaaaagtataataaaattagtattcaaaatgtg

SEQ ID NO: 192785 - DNA, 2075 bp, Homo sapiens
  Payload ID: 18055
  Gene Name: transient receptor potential cation channel, subfamily M, member 3
  ENST ID: ENST00000377101
  CDS Start-End: 350-1321
agcaaaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattggtaggtaattccgcatgggtggccagctgtctccacattttcagtcattttcttgaatcacacaacattttctcaaatcatgcaacattctctctttctggccgagcttacagctctcctcaggctccattggctccagtagcttcctctcctaagtaactaagacactgcttttactgccttcgagttaataaggtgtgtgcagcagagttttagcatcatttccttttggagctcatccaaacgctctgactgcctcaacaaaatgagttgaagtgataaaattggtcccctcctggagaacgcttcagcttgatcttcttaggtttcggatttcattttgcttggaagtcatgaaccactgaggtgctttctgtcaaatagctttaatgacaaagggtccaggctgttacactaatctgtacaggtagaaaacggagaaacataagaaatcctggaggaatctaaaatcagagcaaaatgtgtttctaaaatcagagcaaaatgtcttacaaatgtggtatgatcagagaccctgctagggtgaacaaaatcatgtgattttgttctctgcttactcaaacatttaacaagaacttgctatctgccaagcagggagcaagatctttatgcatataaactcatatgacctttgcaactgtcctgatgagagaggtacaattattaccctcatcttacagatgaggaaacccggctcatttgattagtaaatgaggagctaagactcaaaaccagtgatgtttaacctctgtatggagtatttttattcagaaagtgtctcactgaagccaatgcagtggatcacccactctgggtagatgcccccaggcctcagccagagagactattctcaaaggtcagttaaacccaactgctgagagagatagcaaaa

SEQ ID NO: 192786 - DNA, 5957 bp, Homo sapiens
  Payload ID: 18055
  Gene Name: transient receptor potential cation channel, subfamily M, member 3
  ENST ID: ENST00000377105
  CDS Start-End: 356-5056
agctgcagcaaaatgaaagcaacaggagctgctccggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaactt

SEQ ID NO: 192787 - DNA, 12258 bp, Homo sapiens
  Payload ID: 18055
  Gene Name: transient receptor potential cation channel, subfamily M, member 3
  Uniprot ID: Q9HCF6
  ENST ID: ENST00000377110
  CDS Start-End: 245-5368
tccgaccacaggctgttttgtgcaggctgtccctcttcttcaaaatcgtgcatcccctccccgaagcagcaggcagtgtgcctccattcagccacatttggtatgcatgagcacggctgcagagagaggggaggtggctgttttaagaaggttcaggggctcaggcaaggctacttgactagtcttccaagttccaggaagcctctgccctaatggaatttgcaggtgtggagatgaccatgggatgccagagccgtgggggaccgtttattttctaggcattgctcaggttttcagtttcttgttttcctggtggaatttggaaggggtcatgaatcaggctgatgctcctcgacccctaaactggaccatccggaagctgtgccacgcagcctttcttccatctgtcagacttctgaaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaaaccttcttaatatccgccacagaaggctcaagaatccagccctaaaattctctccaactccagtttttcccctttccttgaatcatacctgctttattcttagctgagcaaaacaagcaatgctttgggaggtgttaactcaaaggtgacttctgggccacagatcaagaaagcatttgatctgacccagtgccagacacaggggatttaaggcatgttcacacttgctgggcagggagggggaagagagggagaaggaagggttagagatgaatgtgtatccgcagtcacagcagaaagccatgagagcaggggaaacaaggggcttcgagcacgctccatgccaggaggcatctgttgatttctgaccattatcaagagttgtaggatgcagggctaaattgcaaaataaaataaaatagccagcgtacacaatgagatattctaaacttccattctgttttcttttcacattggctccatcactggtgactgatgaagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaacttaaaaaaaaaaaaaaaaaaacagtggacagaactagcctgaaattgccatgtgggatgttctgttctcaccgttcatgtcgtgtgttgtgctgctgtgtgaccgtcatcatttgcatggctccaccacgtcctcctgaacacctccaagacgtaactgccaatttttcacaccactcatcacatgaccattttgtatatgaatatatggttatatgtggatattttcatacctagagttttgccatctaatctgagctcagcataaatttaattggagtttttcaagggctggtatcttttctatggaaatgttccaaagtactttttaaggaagtttcaaaactataaataaccttagatttgactgggagtttggtatcaacccaaagccatcagttgcaagcataccatgaatatttttcttatagacagagctataaaaaaagatacagtagaccaaaatagaaagcaaataaaccatataaagagttctatagtatatgccacttatacacatgtatatgcatttatgcagagacacatatttatatataaaataaatggacataaagagctttcttaagaggcttggacttttctatcaccttgaagtataatcaagattttttttaatatacaagaagttccattgaaagagttcattatactattagaccaaatgttgaaattatgaattttttaaattcctatgacttttcctcatatcaaactagagttgtcaaaatgactcactgctcgccttctgcccttttttgtctgaaatcactcactatcaggacatctcatttagtctcgcttttcctaaacaaagtttttacaccacgtacaatctgaatagacacgcaactttaaaccagctagtgttacagactctaaagtagaggcataatcttctagatcagaatctggattggaagtgggataaagaaatcttgaccccaaatctttggattcctatttggctcattaacgtttaaaaaagaataaagcctttaaggaaaacaatctattgttcctggcctgagatactacctggttcttttgtttaattataattgaaaacaccaagttttactttattttgtgaaatcaagtaaatacatggcctttaaatataagataaaaaacaaaataaaaactcttctgaataagcatttcaggtataaaaattgtgatgaggtcacatatgtaaagaattaaacaattcctttttcactccttggcatttaggtgaattgctaacaaacacccagactcccttatttacagctgttctagaaacacttaacattttattgggccccacgctggctatttccctctcagcaaacatgcactgggtctgagaataaatcagtcgttcttaaacttccttgagtcatgaatccctacgaggctctacgataactctaggctctctctccagaaagaaaaaaaaaatgtacataatgcaaagttgcaatataacttgaaagggttcatgagcccctggttctatattgattatgagggaaaggaaccatgtttgctcgtagttaatgcagttgtaataggcactttacatttgagaccatctctctgtgattctcaggaaggccaaatctcagcaccagagtttgaacaaagattttgttatttttgttctttaaattagatgttgccaatttaatgcacttacatcctaacatgttgatgattttaagtatcaagcacaatcacaatgctgaagtctccctgaagggtctatagaggaatccaagaaggaggtgaaaacattattcattgacatcaaacacctccaaggcctcattctgggccagattggaagtgagggaaagaaattttcagctcaagtgtttccattcatcgtgatttcagagagaaaaggataggaactgggaaacgaaatactcaacagtcctgatcttgcaattacctgattcttttgttgtgcatgaaaattaagttctaacgtctgtgaaacgtgtgaaatatataagccaaacttaaatgactgtagacacaaactgtgtaacttccatgagccatttccttcctgtgcacatgtatgtgtgttatttttcagtccatttccttccatttctgggttctctgtgcagcaatgtggcattgattctgtggccttgtgcagtcagcttatgctcagcccattgattccaccacatccctgatcgaggggacgttaattacctgtctttgtgaattaagcagtttatgagcagcaagttactgaggaccgtaaataaagtcatagagagctcaaggaagtaatagcttcggtttaatcatctgcttcaaaggtgccaatttttacatactactatatgtaatgatttgttctaaattgcttgttccttttgaaaaaaatttaaggatgttttatgaaaatgaccatggaggtctcctgcttaaccaatatactttatatttatagttagagggcccctccttgatagatttgaatgaggagctggaaagcttgggtacaattttcatgactagtttgtattatctctgcaagccaaaaggtgtattagcagtcagaatacagcactttacagaactggattttttaaatgtataagtttccaggtctaggatattatttagcactttgaaagttccccttttaaaatatatatataagaataatcaaacgagaaaaatgtactcataaaaacacaaaatgtgtttcttctgaatgtttcaaatgtattctaaaatatggtttctatagataatattatggtagataactggatagtacttttttactttctgagtctgtacagtctaatcttcctgaatgtttgggctgtttaatttctttaaagatgataaatattacccggtcatccatcatgctctatctataggctataccattcatatgttgggcaatgctgtattataaaacacatgtaaacatgtatgtaacccatgtttaacccagcgtagttgtagcatgtggttgtattaatgaacgttacaggagagctttataatcatttataaatctgtaacattcaataaagaaacacatgttgcaatgattaattatgttcccaattccatgttatttagcatctttgtgaaccgggcatttttgttcctgatctgcttgatgcttttcatgttcctttggaccactgtaaaatatgtgtgtaagctgatgtatatcctctaatgagtcctgcgagctgtggtaggcaagttgtgattttgtgaaagatgaactggcatgttatgcaaaagactatatgacaaatgaacttaaaatgatattttaaactccagttgaattagctgtttacatctgccaaccccatgcagaagcagtgtacagtattttataaatatgttcatttagtaacactatgttgtttctagataaagtgatactagtgtgtaggtggttatatatttggcctagatattgcattataactcactatccttgaacaataacaatgtgactgaaatgaagtaatctctctccaaacctggtcttaattttgtgtcaacaaaatgcatgcactgctttatgcatttcttttgacttttctaaggcacttaacattttactattgcctgctgtgacgcttaagccagttaagaattcactcaaacagttgggcttcttactatggggattatgttcagttttgaaaaattaaaaacaaaaaaaaagtaaccaagggatttttaaatcttttttttaagcactgaacaaataatatgaaataaagtattaactgcaggttgtatagccatgggacccagaggtggcaagccaacacctcttgggtctgccaaggtctaggtgttgtgcatctgtgatatatgcaagacacatttctgattcttcagagctactgggtgcaaattgctaagccggagatgagagcgaaaagtccatttgtgatagtgcagaagtgcgcagatcgctgtgaatgtgtgatccaatgatatgacaagagacctccctccttgtcttgtggcttcttcaccttgggggtgggaggcgtgtgtttgggtgtctgatgaagcactgggtggttctaaagagtttactcttttagaaaatcatcattactagaagccattcaacatctgttaaagagaggagccaatttgcacagttttgaaaatgactgctcctaaaatgagtagacaaaactttcctctcagcctgcattgacctaagctttctcttctttttacaagttggatattctgtctctcagattggagtcaaccaaaagaaaggctggttccaattaaggaaaagcaatttttttcttttaattcctctcagaaggtagttgtgttaccttttctctgatgatttccttgcactcatcactgctaatgaaagcaacgtgactgtttctacaggtcatctaagagaggattttggtgaccaggtaatccagatggcaataagaatgaggtgaattttcccttccttaccttacctagtctaccagcctccttaaacctgcaggcccttgtgcgtttgcacaatgtttgtgtgctggaaactgaaaagacatgtgtatggctagaagtccataggctttgtaaagagtgtcagtgccaatcaggacccatgccttcctctggaggagacaggtggctgaggcctatggggcaaagggggaaattcagccttgtgcctggatgtgcggctttctttctcccctcttcttgcttctcttctcttagtctaagactagctgctttttcaccagaccaacagacccttgcccacattacctttataccttgttgaccctcgcacagtaagctgaaacagcggccgcttggaaaaaggcaaacatttagactttgtcccaggcctgatcttcccaccaacttagcctcctcctgcctctaccccggctggtgttcacattgacctcgtccaatttttgcctctctaaatctcaagagtcctacacatcttcaccgcagcttcccacacatcattaaaaccagccatctgcacatagactgagaggctgcaaattcaaacacatggaggggccggatccagaaaacacaaatgtgtgaactggactggtgaaagtcaacagaagtagggtttgtaagtaaggcatgacagaatacacatcccaccacaaacaccttcaaattcagctttccaaacactgtcctagccaaacaaacatgtctgccagcagcattcagtcccaaaggcaatagtttgggacctctgatttagagccaacaggatcagattcttgatagtgacttggtgagtgtacacacaaaatacactgagaaccgagaggggggaaaagaaactcgccttattcagagttactcttgttctgaatgatatatgcatgtatatttgttagccacataattctaaacttgaacacagagtctttgtgagagagattcagaagaagagtaccatagcatggtatgaagacttacctgcttcctgtcactactgcgtctgacctgagtttatattgctgctaccgctgtgtaaaaacagtacgtgcagtatactgtactcatagccatttcataatataggacctagactctcatttgtaaacgttctaaccctagtttataatgggggaaattattcagatatcatttttaaatgaattcctacaaatacaatggttttaaaattgggtttgctgaatatatatacatcttttccttctttgtgtatggatggaccacggtatgcatatctatcgacactataaatatatataaatccttagaagaattgttcttttttaaaggtctattattggattcacaatgcactttgagtttgattgtttagatatacaattcagagcagaagttggcagataccacgggaaaaactttctgaaatttctgtaacaaatgttttgcaataaaaaaaaaaactcagtagtttaaaaca

SEQ ID NO: 192788 - DNA, 4618 bp, Homo sapiens
  Payload ID: 18055
  Gene Name: transient receptor potential cation channel, subfamily M, member 3
  Uniprot ID: Q9HCF6
  ENST ID: ENST00000377111
  CDS Start-End: 245-4222
tccgaccacaggctgttttgtgcaggctgtccctcttcttcaaaatcgtgcatcccctccccgaagcagcaggcagtgtgcctccattcagccacatttggtatgcatgagcacggctgcagagagaggggaggtggctgttttaagaaggttcaggggctcaggcaaggctacttgactagtcttccaagttccaggaagcctctgccctaatggaatttgcaggtgtggagatgaccatgggatgccagagccgtgggggaccgtttattttctaggcattgctcaggttttcagtttcttgttttcctggtggaatttggaaggggtcatgaatcaggctgatgctcctcgacccctaaactggaccatccggaagctgtgccacgcagcctttcttccatctgtcagacttctgaaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcagagcatcctctttattcagtataagccggcagcaagcagttctacctaacgtcccacatccttctcatgccaacacttctgtaattgatcattataaagaaaaaacaaggtaacagtcatagttcacctgtctcttatctattcacttctggtgccacaactgtttatccttttttgaagaaaataagggaacagaaatgcctttttgtattgcaatcgaaatgaaagaagagttgatgttaaaaaaacaaaagtcaagtgatttattatatacagtgggcgttcaagtctagtcgagcaagctcaggagaatgtaattaaataattttatattttttaatttattttgtatctcacctgtcatggatgaattcattcactgaatatgtaatattgaacttaaaaaaaaaaaaaaaaaaa

SEQ ID NO: 192789 - DNA, 4671 bp, Homo sapiens
  Payload ID: 18055
  Gene Name: transient receptor potential cation channel, subfamily M, member 3
  ENST ID: ENST00000396280
  CDS Start-End: 1-4671
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagagggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 192790 - DNA, 3484 bp, Homo sapiens
  Payload ID: 18055
  Gene Name: transient receptor potential cation channel, subfamily M, member 3
  ENST ID: ENST00000396283
  CDS Start-End: 321-1148
ggggactgcttttgccagtacccagaatcagtgctcaggctcagaaatcctggatagaaagagcattttataaaagagaatgtgtccacatcatacccagcaccaaagacccccataggtgttgctgtgggcgtctgataggccagcatgttggcctcacccccagtatctccgtgcttcagaatgagaaaaatgaaagtcgcctctcccgaaatgacatccagtctgaaaagtggtccatcagcaaacacactcaactcagccctacggatgcttttgggaccattgagttccaaggaggtggccattccaacaaagccatgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggctcaaaatatataaccaatctaaaaagagaaagaaaaaaggaagaggaaagcaaaggtatttagaagtgaaatggtgctagttgatggcgaatgacggtcctctcagctgagaggcagggttccaggggccagcattggaagctcagcatctgcagtgtcctaccccagcttccttcgactttacagttggaatgaacagcctttaaagagtcctaacctcccacttgtcttgattgatttttacttttttaaagtccttgaattcttcctcaagtgaaatctcaggtagaggtgcaatatgtaatacagacaaggtgcgggtttactctgtcaaagctgggataggaggcctagaccatgattctcaaattttattctgcatcagaatcacccagagggcttgtgaaaataaatggctatacaggaggaacgagttgaggagatgtatcgtacatcatggggactatagtcaataacaatatattgtatacttgaaaattgctgagaatagatttcaagttttctcaccataataaaatgaaagtatgtgagttaatgcatatgttaattagcttgatctagccattccacagtgtatacacatatcaaaacataccataaataccataaatacatacaatttttgtcaattagatatgcattttttaaaataagaggaaaaaactacaaaaaaaaaaatctcacaattgctggctccacccccagattttctaattcaataaatctggttgaggtcaggtaatttgcatttcaaaggaatacttaggcgatgctatgcttttggtccagagacgatactttcagaactattttcctagggcctcctttctgcctggctctcacctacaaaggcagctctgaggcagctgtggagctcctcctcaaaattccgggggcttctttgtgaaactccattgaagacccctgacctacaggtcaagatcacattcctttgcttggactcaagatccactgtatcctggccccagcttttctctagagccagctctcactcaacaaaccttccattcaccctacaacccaatggagctgtcctccccactgttctccaagcacttcctgctgtcacaaggcttctctgccttaccatgagatgcacaaatgcatttctttacccatttaatttctagtaaatttttctctgaagtttcacaaactagcctctctcacaaaaagatgtagtaagggctttaaaacccacaaatttatctgagtgaggtgcaaataataaaatgtactggtgtttcattcctttcctttagaggaaatagattctgaatcaacctggctgacattaggatctacagctgctagggatacagtggattaatgccttacctagtggtattattaataataaataatgtttgggatgtttttaatggattttctccagattcctcatgcaattctcagatgttggtcacggaccacaggatttatgaaaactatatagagcagtgaacacatgctataaaagcttcttcagtcagagaaacactaaaaatgcattaaagtaggatttcaagattaactcaagtctgcactactgttgtctagaaaagtctccattcagtttcaataacatctttttgcactatcctaattgttggacaactctcttagagtcgatgtacatatttattatgttttcttgggatattccatgcaaagcaagtgtccattcatgagcataaacctctaaaagtcttgagtaagcagtaaataatccattcctctaaatccatagaaccatgattcagtgtcttggagacaaacttaaaatttggagttgtttaagcctatcatctccttggtttttgccatttgatagtaaatttgagattttattatctctaatgcattgatgacaaatacagttgacccttgaatgacatgaggttagagttgccaaccccccatgtggtcaaaaatccatgtataacttttgacttcccaaaaacgtaactactaatagttcatcattggccaaaagccttactagtaacatatcaacatacattttgtatgttacatgtataatatatttttacaataaagtaagctagagaaaagaaaatattgagaaaaccataaggaagagaaaatatatttactattcattaagtggaagagatcatcataaaggtcttcatcattgtcgttttcatattgaataggctgaagaggaggaggaagaagaggaggggttggtcttgctatctcaggggtggcagaggaagaaaaaaaattagagtgtaagtgaacccgcacagttcaaacccctgttgttcaagggtaaactgtagtttaaatctgagtgtcaactccaataaattggtagaggcttcctggaa

SEQ ID NO: 192791 - DNA, 4701 bp, Homo sapiens
  Payload ID: 18055
  Gene Name: transient receptor potential cation channel, subfamily M, member 3
  ENST ID: ENST00000396285
  CDS Start-End: 1-4701
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccgtaagcaagtttatgattctcatacaccaaagtcagctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 192792 - DNA, 4740 bp, Homo sapiens
  Payload ID: 18055
  Gene Name: transient receptor potential cation channel, subfamily M, member 3
  ENST ID: ENST00000396292
  CDS Start-End: 1-4740
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagatgcctgccgtttttctctcttgactcccgcttgttttattcattttggggtagttgccagttagactcagttggaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 192793 - DNA, 4701 bp, Homo sapiens
  Payload ID: 18055
  Gene Name: transient receptor potential cation channel, subfamily M, member 3
  ENST ID: ENST00000408909
  CDS Start-End: 1-4701
atgtatgtgcgagtatcttttgatacaaaacctgatctcctcttacacctgatgaccaaggaatggcagttggagcttcccaagcttctcatctctgtccatgggggcctgcagaactttgaactccagccaaaactcaagcaagtctttgggaaagggctcatcaaagcagcaatgacaactggagcgtggatattcactggaggggttaacacaggtgttattcgtcatgttggcgatgccttgaaggatcatgcctctaagtctcgaggaaagatatgcaccataggtattgccccctggggaattgtggaaaaccaggaggacctcattggaagagatgttgtccggccataccagaccatgtccaatcccatgagcaagctcactgttctcaacagcatgcattcccacttcattctggctgacaacgggaccactggaaaatatggagcagaggtgaaacttcgaagacaactggaaaagcatatttcactccagaagataaacacaagaatcggtcaaggtgttcctgtggtggcactcatagtggaaggaggacccaatgtgatctcgattgttttggagtaccttcgagacacccctcccgtgccagtggttgtctgtgatgggagtggacgggcatcggacatcctggcctttgggcataaatactcagaagaaggcggactgataaatgaatctttgagggaccagctgttggtgactatacagaagactttcacatacactcgaacccaagctcagcatctgttcatcatcctcatggagtgcatgaagaagaaggaattgattacggtatttcggatgggatcagaaggacaccaggacattgatttggctatcctgacagctttactcaaaggagccaatgcctcggccccagaccaactgagcttagctttagcctggaacagagtcgacatcgctcgcagccagatctttatttacgggcaacagtggccggtgggatctctggagcaagccatgttggatgccttagttctggacagagtggattttgtgaaattactcatagagaatggagtaagcatgcaccgttttctcaccatctccagactagaggaattgtacaatacgagacatgggccctcaaatacattgtaccacttggtcagggatgtcaaaaagcgagagtatccaggtttcggttggatctattttaaggggaacctgcccccagactacagaatcagcctgattgacatcggcctggtgatcgagtacctgatgggcggggcttatcgctgcaactacacgcgcaagcgcttccggaccctctaccacaacctcttcggccccaagaggcccaaagccttgaaactgctgggaatggaggatgatattcccttgaggcgaggaagaaagacaaccaagaaacgtgaagaagaggtggacattgacttggatgatcctgagatcaaccacttccccttccctttccatgagctcatggtgtgggctgttctcatgaagcggcagaagatggccctgttcttctggcagcacggtgaggaggccatggccaaggccctggtggcctgcaagctctgcaaagccatggctcatgaggcctctgagaacgacatggttgacgacatttcccaggagctgaatcacaattccagagactttggccagctggctgtggagctcctggaccagtcctacaagcaggacgaacagctggccatgaaactgctgacgtatgagctgaagaactggagcaacgccacgtgcctgcagcttgccgtggctgccaaacaccgcgacttcatcgcgcacacgtgcagccagatgctgctcaccgacatgtggatgggccggctccgcatgcgcaagaactcaggcctcaaggtaattctgggaattctacttcctccttcaattctcagcttggagttcaagaacaaagacgacatgccctatatgtctcaggcccaggaaatccacctccaagagaaggaggcagaagaaccagagaagcccacaaaggaaaaagaggaagaggacatggagctcacagcaatgttgggacgaaacaacggggagtcctccaggaagaaggatgaagaggaagttcagagcaagcaccggttaatccccctcggcagaaaaatctatgaattctacaatgcacccatcgtgaagttctggttctacacactggcgtatatcggatacctgatgctcttcaactatatcgtgttagtgaagatggaacgctggccgtccacccaggaatggatcgtaatctcctatattttcaccctgggaatagaaaagatgagagagattctgatgtcagagccagggaagttgctacagaaagtgaaggtatggctgcaggagtactggaatgtcacggacctcatcgccatccttctgttttctgtcggaatgatccttcgtctccaagaccagcccttcaggagtgacgggagggtcatctactgcgtgaacatcatttactggtatatccgtctcctagacatcttcggcgtgaacaagtatttgggcccgtatgtaatgatgattggaaaaatgatgatagacatgatgtactttgtcatcattatgctggtggttctgatgagctttggggtcgccaggcaagccatcctttttcccaatgaggagccatcatggaaactggccaagaacatcttctacatgccctattggatgatttatggggaagtgtttgcggaccagatagaccctccctgtggacagaatgagacccgagaggatggtaaaataatccagctgcctccctgcaagacaggagcttggatcgtgccggccatcatggcctgctacctcttagtggcaaacatcttgctggtcaacctcctcattgctgtctttaacaatacattttttgaagtaaaatcgatatccaaccaagtctggaagtttcagaggtatcagctcatcatgactttccatgaaaggccagttctgcccccaccactgatcatcttcagccacatgaccatgatattccagcacctgtgctgccgatggaggaaacacgagagcgacccggatgaaagggactacggcctgaaactcttcataaccgatgatgagctcaagaaagtacatgactttgaagagcaatgcatagaagaatacttcagagaaaaggatgatcggttcaactcatctaatgatgagaggatacgggtgacttcagaaagggtggagaacatgtctatgcggctggaggaagtcaacgagagagagcactccatgaaggcttcactccagaccgtggacatccggctggcgcagctggaagaccttatcgggcgcatggccacggccctggagcgcctgacaggtctggagcgggccgagtccaacaaaatccgctcgaggacctcgtcagactgcacggacgccgcctacattgtccgtcagagcagcttcaacagccaggaagggaacaccttcaagctccaagagagtatagaccctgcaggtgaggagaccatgtccccaacttctccaaccttaatgccccgtatgcgaagccattctttctattcggtcaatatgaaagacaaaggtggtatagaaaagttggaaagtatttttaaagaaaggtccctgagcctacaccgggctactagttcccactctgtagcaaaagaacccaaagctcctgcagcccctgccaacaccttggccattgttcctgattccagaagaccatcatcgtgtatagacatctatgtctctgctatggatgagctccactgtgatatagaccctctggacaattccgtgaacatccttgggctgggcgagccaagcttttcaactccagtaccttccacagccccttcaagtagtgcctatgcaacacttgcacccacagacagacctccaagccggagcattgattttgaggacatcacctccatggacactagatctttttcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgttcccaagatagagcgcgccaacagctactcggcagaggagccaagtgcgccatatgcacacaccaggaagagcttctccatcagtgacaaactcgacaggcagcggaacacagcaagcctgcgaaatcccttccagagaagcaagtcctccaagccggagggccgaggggacagcctgtccatgaggagactgtccagaacatcggctttccaaagctttgaaagcaagcacaactaa

SEQ ID NO: 192794 - DNA, 4109 bp, Homo sapiens
  Payload ID: 18056
  Gene Name: transient receptor potential cation channel, subfamily M, member 4
  Uniprot ID: Q8TD43
  ENST ID: ENST00000252826
  CDS Start-End: 127-3771
ctcgccccgccccaggctaggctggaaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 192795 - DNA, 3444 bp, Homo sapiens
  Payload ID: 18056
  Gene Name: transient receptor potential cation channel, subfamily M, member 4
  Uniprot ID: Q8TD43
  ENST ID: ENST00000427978
  CDS Start-End: 53-3262
ggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggc

SEQ ID NO: 192796 - DNA, 3349 bp, Homo sapiens
  Payload ID: 18056
  Gene Name: transient receptor potential cation channel, subfamily M, member 4
  ENST ID: ENST00000598697
  CDS Start-End: 102-413
aaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagagg

SEQ ID NO: 192797 - DNA, 3702 bp, Homo sapiens
  Payload ID: 18056
  Gene Name: transient receptor potential cation channel, subfamily M, member 4
  ENST ID: ENST00000595519
  CDS Start-End: 76-309
gcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccggggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagaggaa

SEQ ID NO: 192798 - DNA, 3695 bp, Homo sapiens
  Payload ID: 18056
  Gene Name: transient receptor potential cation channel, subfamily M, member 4
  ENST ID: ENST00000598502
  CDS Start-End: 36-686
cctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatccctgtcctgctcctcctgattgatggtgatgagaagatgttgacgcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtggagaggattatgacccggaaggagctcctgacagtctattcttctgaggatgggtctgaggaattcgagaccatagttttgaaggcccttgtgaaggcctgtgggagctcggaggcctcagcctacctggatgagctgcgtttggctgtggcttggaaccgcgtggacattgcccagagtgaactctttcggggggacatccaatggcggtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgagatgtatctgctctcggacaaggccacctcgccgctctcgctggatgctggcctcgggcaggccccctggagcgacctgcttctttgggcactgttgctgaacagggcacagatggccatgtacttctgggagatgggttccaatgcagtttcctcagctcttggggcctgtttgctgctccgggtgatggcacgcctggagcctgacgctgaggaggcagcacggaggaaagacctggcgttcaagtttgaggggatgggcgttgacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacagtctctgctgacacagaagtggtggggagatatggccagcactacacccatctgggccctggttctcgccttcttttgccctccactcatctacacccgcctcatcaccttcaggaaatcagaagaggagcccacacgggaggagctagagtttgacatggatagtgtcattaatggggaagggcctgtcgggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggctgaccccgggtttgtaccacctgggccgcactgtcctctgcatcgacttcatggttttcacggtgcggctgcttcacatcttcacggtcaacaaacagctggggcccaagatcgtcatcgtgagcaagatgatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacgtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgggtttacctttctaaggaagccgagcggaagctgctaacgtgggaatcggtgcataaggagaactttctgctggcacgcgctagggacaagcgggagagcgactccgagcgtctgaagcgcacgtcccagaaggtggacttggcactgaaacagctgggacacatccgcgagtacgaacagcgcctgaaagtgctggagcgggaggtccagcagtgtagccgcgtcctggggtgggtggccgaggccctgagccgctctgccttgctgcccccaggtgggccgccaccccctgacctgcctgggtccaaagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggc

SEQ ID NO: 192799 - DNA, 780 bp, Homo sapiens
  Payload ID: 18056
  Gene Name: transient receptor potential cation channel, subfamily M, member 4
  ENST ID: ENST00000597316
  CDS Start-End: 1-155
agcggaagctgctaacgtgggaatcggtgcataaggagaactttctgctggcacgcgctagggacaagcgggagagcgactccgagcgtctgaagcgcacgtcccagaagtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagagg

SEQ ID NO: 192800 - DNA, 594 bp, Homo sapiens
  Payload ID: 18056
  Gene Name: transient receptor potential cation channel, subfamily M, member 4
  ENST ID: ENST00000598691
  CDS Start-End: 127-594
ctcgccccgccccaggctaggctggaaagtggaggatccggtttgctctgggcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccgggagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggagggactggaattgacatc

SEQ ID NO: 192801 - DNA, 1829 bp, Homo sapiens
  Payload ID: 18056
  Gene Name: transient receptor potential cation channel, subfamily M, member 4
  ENST ID: ENST00000599628
  CDS Start-End: 76-171
gcgggtctggaagcagagccggcggagggagcgccggggccctgggctgcaggaggttgcggcggccgcggcagcatggtggtgccggagaaggagcagagctggatccccaagatcttcaagaagaagacctgcacgacgttcatagttgactccacagatccggggtgaggagttcgcccctggactgaccccagagggtccgcggcccgctgaccccgcccgcggatggtcacgccccagccctgctccttccccattcctggactcggggaccttcccaagggcgttccttgccgacgctctccctctaggagcgtttgggtctgtgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgggcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagtttttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttggtcttgaactcttgatctcaggcaatgcacctgccttggctttccaaagtactgggattacaggtgtgagccaccgcgcccagccctctagttgtttttcaagacagtttttggggtgcgggaagtatccacattcctacttcagtgtgtattttgttatgactatatattagtgcagtatggcttgtaaatgatggataaataaacagatatgcgcttgttgg

SEQ ID NO: 192802 - DNA, 3929 bp, Homo sapiens
  Payload ID: 18057
  Gene Name: transient receptor potential cation channel, subfamily M, member 5
  Uniprot ID: Q9NZQ8
  ENST ID: ENST00000155858
  CDS Start-End: 10-3507
gaggccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaa

SEQ ID NO: 192803 - DNA, 3562 bp, Homo sapiens
  Payload ID: 18057
  Gene Name: transient receptor potential cation channel, subfamily M, member 5
  ENST ID: ENST00000533060
  CDS Start-End: 7-3528
gccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagcctgaccacctgctcctgccgcagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctc

SEQ ID NO: 192804 - DNA, 3902 bp, Homo sapiens
  Payload ID: 18057
  Gene Name: transient receptor potential cation channel, subfamily M, member 5
  ENST ID: ENST00000533881
  CDS Start-End: 1-3480
cccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaa

SEQ ID NO: 192805 - DNA, 3535 bp, Homo sapiens
  Payload ID: 18057
  Gene Name: transient receptor potential cation channel, subfamily M, member 5
  ENST ID: ENST00000528453
  CDS Start-End: 7-3507
gccaccatgcaggatgtccaaggcccccgtcccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggacaggctctcagcactgtggcgagggaagccagctggtggctgctgaccacagaggtggtttagatggctgggaacaacccggggctggccagcctccctcggacacctgagctgcttggcctgccacgtgtggggcca

SEQ ID NO: 192806 - DNA, 1568 bp, Homo sapiens
  Payload ID: 18058
  Gene Name: transient receptor potential cation channel, subfamily M, member 6
  ENST ID: ENST00000359047
  CDS Start-End: 239-1150
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgtgagtatcacaggggctcagtcacccagtctggttgcaggcctgctgaggtctttcatggtcttccctgaccatcagagctagcttgaggggactaggggtgtgagctttgatggtcagggaagatgacatttcatgtgttggtggggtggccctaggcagggaaggggttaagaccagacaggatttttagaaatagggaccttggggctgggtgtggtggctcacgcctgtaatcccagcactttgggaggctgaggcgggtggatcacctgaagtcaggagtcgagaccaacctggccaacatggtgaaaccctgtctctgctaaaaatacaaaaattagccaggtgtggtggtgcatgcctgtaatcccagctactcaggaggctgaggcaggagaatgacttgaacctggggtgtagaggttacagtgagctgagatcgccccactgcacttcagcccaggtgacagagcaagactctgtctc

SEQ ID NO: 192807 - DNA, 8425 bp, Homo sapiens
  Payload ID: 18058
  Gene Name: transient receptor potential cation channel, subfamily M, member 6
  Uniprot ID: Q9BX84
  ENST ID: ENST00000360774
  CDS Start-End: 239-6307
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgtcttggagcgcttgcagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 192808 - DNA, 8271 bp, Homo sapiens
  Payload ID: 18058
  Gene Name: transient receptor potential cation channel, subfamily M, member 6
  Uniprot ID: Q9BX84
  ENST ID: ENST00000361255
  CDS Start-End: 100-6153
gctttccgaggcggctggagaagtgcccagacggccgtccctccgcgcccctgcgcgtccccgtgcgcccagtgttccccgtgcaggagtcccggagcgatgacagcgccggttacgtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 192809 - DNA, 8244 bp, Homo sapiens
  Payload ID: 18058
  Gene Name: transient receptor potential cation channel, subfamily M, member 6
  Uniprot ID: Q9BX84
  ENST ID: ENST00000449912
  CDS Start-End: 73-6126
atctaacgaggatctagaatagctaggatttatgaaataccggctttcaagttctctggtctccacccaaagatgattatcctatctaagtcccagaaatcctggattaaaggagtatttgacaagagagaatgtagcacaatcatacccagctcaaaaaatcctcacagatgtactccagtatgccaagtctgccagaatttaatcaggtgttactgtggccgactgattggagaccatgctgggatagattattcctggaccatctcagctgccaagggtaaagaaagtgaacaatggtctgttgaaaagcacacaacgaaaagcccaacagatacttttggcacgattaatttccaagatggagagcacacccatcatgccaagtatattagaacttcttatgatacaaaactggatcatctgttacatttaatgttgaaagagtggaaaatggaactgcccaagcttgtgatctcagtccatgggggcatccagaactttactatgccctctaaatttaaagagattttcagccaaggtttggttaaagctgcagagacaacaggagcgtggataataactgaaggcatcaatacaggagtgtccaagcatgttggggatgccttgaaatcccattcctctcattccttgagaaaaatctggacagttggaatccctccttggggtgtcattgagaaccagagagaccttattggaaaagatgtggtgtgcctgtaccagactctggataaccccctcagcaagctcacaacactcaacagcatgcactcgcacttcatcctgtctgatgatgggaccgtgggcaagtatggaaatgaaatgaagctcagaaggaacctggagaagtacctctctctgcagaaaatacactgccgctcaagacaaggcgtgccggtcgtggggctggtggtggaaggcggtcccaacgtcatcctgtcagtgtgggagactgtcaaggacaaggacccagtggtggtgtgtgagggcacaggtagggcggctgacctcctggccttcacacacaaacacctggcagatgaagggatgctgcgacctcaggtgaaagaggagatcatctgcatgattcagaacactttcaactttagtcttaaacagtccaagcaccttttccaaattctaatggagtgtatggttcacagggattgtattaccatatttgatgctgactctgaagagcagcaagacctggacttagcaatcctaacagctttgctgaagggcacaaatttatcagcgtcagagcaattaaatctggcaatggcttgggacagggtggacattgccaagaaacatatcctaatttatgaacaacactggaagcctgatgccctggaacaagcaatgtcagatgctttagtgatggatcgggtggattttgtgaagctcttaatagaatatggagtgaacctccatcgctttcttaccatccctcgactggaagagctctacaatacaaaacaaggacctactaatacactcttgcatcatctcgtccaagatgtgaaacagcatacccttctttcaggctaccgaataaccttgattgacattggattagtagtagaatacctcattggtagagcatatcgcagcaactacactagaaaacatttcagagccctctacaacaacctctacagaaaatacaagcaccagagacactcctcaggaaatagaaatgagtctgcagaaagtacgctgcactcccagttcattagaactgcacagccatacaaattcaaggaaaagtctatagtccttcataaatcaaggaagaagtcaaaagaacaaaatgtatcagatgaccctgagtctactggctttctttacccttacaatgacctgctggtttgggctgtgctgatgaaaaggcagaagatggctatgttcttctggcagcatggagaggaggccacggttaaagccgtgattgcgtgtatcctctaccgggcaatggcccatgaagctaaggagagtcacatggtggatgatgcctcagaagagttgaagaattactcaaaacagtttggccagctggctctggacttgttggagaaggcattcaagcagaatgagcgcatggccatgacgctgttgacgtatgaactcaggaactggagcaattcgacctgccttaaactggccgtgtcgggaggattacgaccctttgtttcacatacttgtacccagatgctactgacagacatgtggatggggaggctgaaaatgaggaaaaactcttggttaaagattattataagcattattttaccacccaccattttgacactggaatttaaaagcaaagctgagatgtcacatgttccccagtcccaggacttccaatttatgtggtattacagtgaccagaacgccagcagttccaaagaaagtgcttctgtgaaagagtatgatttggaaaggggccatgatgagaaactggatgaaaatcagcattttggtttggaaagtgggcaccaacaccttccgtggaccaggaaagtctatgagttctacagtgctccaattgtcaagttttggttttatacgatggcgtatttggcattcctcatgctgttcacttacaccgtgttggtggagatgcagccccagcccagcgtgcaggagtggcttgttagcatttacatcttcaccaatgctattgaggtggtcagggagatctgtatttcagaacctgggaagtttacccaaaaggtgaaggtatggattagtgagtactggaacttaacagaaactgtggccattggcctgttttcagctggcttcgtccttcgatggggtgaccctccttttcacacagcgggaagactgatctactgcatagacatcatattctggttctcacggctcctggacttctttgctgtgaatcaacatgcaggtccatatgtgaccatgattgcaaaaatgacagcaaacatgttctatattgtgatcatcatggccatagtcctgctgagctttggagtggcacgcaaggccatcctttcgccaaaagagccaccatcttggagtctagctcgagatattgtatttgagccatactggatgatatacggagaagtctatgctggagaaatagatgtttgttcaagccagccatcctgccctcctggttcttttcttactccattcttgcaagctgtctacctcttcgtgcaatatatcatcatggtgaacctgttgattgctttcttcaacaacgtttacttagatatggaatccatttcaaataacctgtggaaatacaaccgctatcgctacatcatgacctaccacgagaagccctggctgcccccacctctcatcctgctgagccacgtgggccttctcctccgccgcctgtgctgtcatcgagctcctcacgaccaagaagagggtgacgttggattaaaactctacctcagtaaggaggatctgaaaaaacttcatgattttgaggagcagtgcgtggaaaaatacttccatgagaagatggaagatgtgaattgtagttgtgaggaacgaatccgagtgacatcagaaagggttacagagatgtacttccagctgaaagaaatgaatgaaaaggtgtcttttataaaggactccttactgtctttggacagccaggtgggacacctgcaggatctctctgccctgactgtggataccctgaaagtcctttctgctgttgacactttgcaagaggatgaggctctcctggccaagagaaagcattctacttgcaaaaaacttccccacagctggagcaatgtcatctgtgcagaggttctaggcagcatggagatcgctggagagaagaaataccagtattatagcatgccctcttctttgctgaggagcctggctggaggccggcatcccccaagagtgcagaggggggcacttcttgagattacaaacagtaaaagagaggctacaaatgtaagaaatgaccaggaaaggcaagaaacacaaagtagtatagtggtttctggggtgtctcctaacaggcaagcacactcaaagtatggccagtttcttctggtcccctctaatctaaagcgagttcctttttcagcagaaactgtcttgcctctgtccagaccctctgtgccagatgtgctggcaactgaacaggacatccagactgaggttcttgttcatctgactgggcagaccccagttgtctctgactgggcatcagtggatgaacccaaggaaaagcacgagcctattgctcacttactggatggacaagacaaggcagagcaagtgctacccactttgagttgcacacctgaacccatgacaatgagctcccctctttcccaagccaagatcatgcaaactggaggtggatatgtaaactgggcattttcagaaggtgatgaaactggtgtgtttagcatcaagaaaaagtggcaaacctgcttgccctccacttgtgacagtgattcctctcggagtgaacagcaccagaagcaggcccaggacagctccctatctgataactcaacaagatcggcccagagtagtgaatgctcagaggtgggaccatggcttcagccaaacacatccttttggatcaatcctctccgcagatacaggcccttcgctaggagtcatagttttagattccataaggaggagaaattgatgaagatctgtaagattaaaaatctttcaggctcttcagaaatagggcagggagcatgggtcaaagcgaaaatgctaaccaaagacaggagactgtcaaagaaaaagaagaatactcaaggactccaggtgccaatcataacagtcaatgcctgctctcagagtgaccagttgaatccagagccaggagaaaacagcatctctgaagaggagtacagcaagaactggttcacagtgtccaaatttagtcacacaggtgtagaaccttacatacatcagaaaatgaaaactaaagaaattggacaatgtgctatacaaatcagtgattacctaaagcagtctcaagaggatctcagcaaaaactctttgtggaattccaggagcaccaacctcaataggaactccctgctgaaaagttcaattggagttgacaagatctcagcctccttaaaaagccctcaagagcctcaccatcattattcagccattgaaaggaataatttaatgaggctttctcagaccataccatttacaccagtccaactgtttgcaggagaagaaataactgtctacaggttggaggagagttcccctttaaaccttgataaaagcatgtcctcttggtctcagcgtgggagagcggcaatgatccaggtattgtcccgagaggagatggatgggggcctccgtaaagctatgagagtcgtcagcacttggtctgaggatgacattctcaagccgggacaagttttcattgtcaagtcctttcttcctgaggttgtgcggacatggcataaaatcttccaggagagcactgtgcttcatctttgcctcagggaaattcaacaacaaagagctgctcaaaaattgatctataccttcaaccaagtgaaaccacaaaccataccctacacaccaaggttcctggaagttttcttaatctactgccattcagccaaccagtggttgaccattgagaagtatatgacaggggagttccggaagtataacaacaacaatggtgatgaaatcacccccaccaacaccctggaggagctgatgttggctttctctcactggacctatgagtacactcggggagagctgctggttttagatttgcaaggtgttggagaaaatttgacagatccatctgttataaaacctgaagtcaaacaatcaagaggaatggtgtttggaccggccaatttgggggaagatgcaattagaaacttcattgcaaaacatcattgtaactcctgctgccggaagctcaaactcccggatttaaaaagaaatgactattcccctgaaaggataaattccacctttggacttgagataaaaatagaatcagctgaggagcctccagcaagggagacgggtagaaattccccagaagatgatatgcaactataaaaagggaggagcaagaagatcccagtgcttgccctgcctgccaggaactctgtgataacatagattgatcaacgtgatgttgattacatcagcgtctccttgggacacgccttctgagcctcacatctccttctgttcaaaggcctcattggtatatgatcaatgggttctcctagacactgacctctgtccagggcactttgcagctccatcctcaagttccacacgaagatgcttggatgagtcagctgggaatattgttcttgtgtacctcattgctttagctggtcacttggaactttggagcagaatcctgcacattaaaggatggggttgggggggatacatttattttattttctcactatgtatgcagactggaccccctactactatttgtcacctcacccacagattgtatttatgtctatatatatgttcataaaaagttatgtgatttcctcctctgtcttttccacaacataggactttgaatagcaatgataggaaaaacaatggaacaagggtgggtttgcacagattggagcacattcctgcacaaactaccaagtatactggtgaaatctcgatgggtttcagatattgtcagtgaatcatatgatgcctggatatttcaggtttctgtaaaagaaagggaaacctaaaacaaatacccttccatatataatatatatggaatatgtatattatatatatttttatatatataatatatatggaatatatatattatatatataaaatacatatggaatatatatattttatatatatatatatatatttttatttttgagatggagtttcactctttttacccaggctggagtgcaatgatgcgatctcactgcaacctctgcctcccgggcttgagcgattcttgtgtctcagtcttccgggtagctgggactacaggtgtgcaccactatgcctggctaattttgtatttttagtagagatggggtttcaccatgttggccaggctggtctcaaactcctgacctcagatgatccacctgccttggcttcccaaagtgctgggattacaggcgtgagccactgcgcctggcctttttttttttttttttaaacgagaacaagaatatgaagaactggaaatcattaagaaagggtttcccttccttaaagctcaggggtactattagttaggagttgactaactcaacctgtaaaacaccactcctccttccaaagttgtatatataatattgcaggttaaattactttatgtcaggtcctatgaagaaagatacggtttcagactgaaaacatgtttcacaggtgtttgcttccttccagagcagagttccctattcccctggcataaagaatgtatatatattttgaaatatggctgagaacatgtcattggtttgtgaggcctaaggtgaagcactcctggcagccacactgtgtagtgtatttgagggatcagtcatccctcttgtatgctgggcctggttgccctacctcgaacaagcaccagcttttcacacaaggagagatgtggggctgggagtcctctccccatcctattgcatctcctttcttattataagctgttccagttcacaggcagcaaacctcctgggtttgaaaaattccaacttatttttatctttaatcctgacattagctgacttgctagtgagcttgctttaaaaatctacactcttgcattcttaggcatacaggggaaatgttgaaaaggaaggtggaaaaccaagaatttagtttgccaatgattgcctctgattcttgtaagtttgagttccacaagggctaatttattccccttttacttgggttttggggtggtggaaagcgggaaatttgggtgatttgttgattggcaatgaggataaaatgttaatacttttttggggacttaacaactttatcctattctacaagtcagtaaaggaacaattggtactcacctcagtgctgcactcaactatggaaagaggcagagtttgcttgcccaattgccaaactaaagacatcagttcattggtcaaatatttgttacctggaatggaacttgaaagcaaatacatttggatttcaaatttc

SEQ ID NO: 192810 - DNA, 10400 bp, Homo sapiens
  Payload ID: 18059
  Gene Name: transient receptor potential cation channel, subfamily M, member 7
  Uniprot ID: Q96QT4
  ENST ID: ENST00000313478
  CDS Start-End: 283-5880
gcgccgctcacgtggtccgtccccagccccgtcgccggcggaggcgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagtgagttctcttgctggatttactgactgtcacagaacttccattcctgttcattcaaaacaagcagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgctctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttacagatgtttagtgagtttaatcattctgaaaaattatctgacattttcagggtgtcaatttgagtatcagtttttttaaatgaaccatttgtatacctgtgcttttgatctcctgtcctgtacaatgtttaaattaatactgatttcttactgtcttcttagaaatctgttttttgttaggccaaaaaagggcaatatgggctgtctgttgatttttaattttatattgattattttcacaggattataatagtagctatacttttttttttttttttttttttgagacggagtctcgctctgttgcttgggctggagtgcagtggtgcgatctcagctcaccacaaccgccgccttccgggtttaagtgattctcctgcctcagcctcccgagtagctgggactacaggcacacgccaccatgcccagctaatttttatatttttagtagagacagggtttcactatgttggccagtgtggtcacaaactcctgaccttgtgagccaccgcacctggctgctaacacttatttagtgcctactgtgtaccagacattactctaagtatttcacatatattaacctacttaatccttataacaatgttataaagaaataggtgttattatcctgttttgcagatttgaaagtcaaggtgctagagaggtaaagtaacgtccataagattcttacgtttatttaataataagtagcaacggtaggatttgaacccaggctggctgcctttcatctatactgtttttgttttgttttgttttgttttgttttgttttgtttgtcttggtggggcatggtggctcatgcctgtaatcccagcacttcgggaggccaaggcaggtggatcacttgggctcaggagtttgagaccagcctgggcaacatggcaaaatcctatctctgctaaaaaaaaaaatacaaaaattaggccaggtgcagtggctcatgcctgtaatcccagcactttgggaggccaaggtgggcggatcacaaggtcaggagttcgagaccagcctgaccaacatagtgaaaccccgtctctactaaaaatacaaaaaattagctgggcatggcggtgagtgcctgtaatcccagctactcaggagtctgaggcaggagaattgcttgaacctgggaggtggaggttgcagtgagctgagatcgtgccattgcgctccagcctgggcaacagtgcgagactccgtcaaaaaaaaaaaaataactggatgtgatggtgtgcacctgtagttccagctacttgggagactgaggtgggaggatcacttgagcctgggagactgaggcagcagtgagctgagatcatgccactgctttccaacctgggcaacagagtgagatcctgtctcagaaagaaaaaaaaaaaaaagacaacctcttgctctgttgcccaggctggagtgtagtagcgtgatcatagctcactgcagccgtaaactcctgggctcaagcaatcctcctgccactgcctcttgattaggtggaaccacaggcatgcaccaccacacgtacctaattttatatatatatttttttatttttcatttttatttatttttgtttttttgagttgaagtctcactctgttgcccaggccggagtacagtggcacaatcttggctcactgcaacctctgcctcccaagatcaagcaattctcgtgcttcagcctccaaagtagctgagattacaggtacccaccataatgcctggctgatttttgtatttttcgtagagacaaggtttcaccttgttggccaggctgatctcaaactcctgacctcaagtgatccacctcccccggctacccaaagtactgggattataggtgtgagccaccatgcctgggtaacacccaactaattttaaatatatattttgtagagatggggtctagccttgttgcccacgctggtctcaaattcctgggctcaagtgatcctctcgcctgagcttcccaaagtggtagaattgcaggcatgaattgctgcacccagcctcatctgtgctgtgaattatgtgctgtattgactctcaagcatgatgaccattggtggtttctgtaccatttcctgttactttactgaaacacacctactccattaacttcttgggttaagtctagaaagtaacagtttacttgtaaaccacatttcttatccccaataagtatttttttaagattattaaagttcattattactaccctatgatgtgaaagtgtcatttgcttaatctttttaattttttattctcaacctcatcttactgaagagaataaaactcttttaccatattcttaaaatgtggaattctcggccaggtgcagtggctcacgcctgtaattccatcactttgggaggccaaggtgggtggatcatctgaggtcaggagttcaagaccagcctggccaacatggtgaaaccccgtctctactaaaaatacaaaaattatctgggtgtggtggcgcgtgcctgtaggcccagctactcaggaggctgaggcaggagaattgcttgaacccaagaggtggaggttgcagtgagcctagattgctgccactgcactccagcctgggtgacagcagaactctgtctcaaaaaaaagatgtggaattcttttctgcaaatgttctctaatagtataccttcttcagtctgtcgatatatgtatgctattattttacaagtaatacatgttgattgtattggaaattatagaaaagattatattggattgtttagaaaatatttttaaatgtgaagaaaaatataaaaattactcccttgttccactttccccactctcaagtcagactatgttgttttcatagttagtagctagcagtctaccccactagattatatgcttcacagagggaagggaccctcaagacttcactggattgagtagcacccaataccttgcttgctgcctggtttgtgatgggcatactgtaagaaaaaaaaatctgaatgacaaaatgtttttccataataccagacttcctcttgaagagatgggtcgtaatgttgtagtcttacatgcttacgtagacaatcaaagcaagaatactcaataaatggctatttaccacttgaaa

SEQ ID NO: 192811 - DNA, 2518 bp, Homo sapiens
  Payload ID: 18059
  Gene Name: transient receptor potential cation channel, subfamily M, member 7
  ENST ID: ENST00000560638
  CDS Start-End: 1-1608
agcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtaagttgacagatgtttgataatactcgtgggtttattgattttttaaaaaatcacaaaaatgttattaacatagttttatttgagccagtgaatgtcttttattttgtgtttgtttgcctcatacttcacatctgccattccttaagagtttctcatgctcaatcccaatcccctatacccatttagtgctttgcaagataatgttagctataccatctatggtttatgtctgtaggtaactcctttttcctgtcttcactgatccaggctttttttttttttttttctttttgagacagagtttcgctctgtcacccaggctggagtgcaatggcactatcttggctcactgcaacctctgcctctcaggttcagcgattctcctgcctcagccacccgaggagctgggattacaggcatgtgccaccatgcccagctaattttgtatttttagtagagacagggtttcaccatgttggtcaggctggtcccaaactcctgacctcagatgatctgcccaccttggcctcccaaagtgctgggattacaggcgtgagccaccacaccctgcttgatccaggctattttttaaaagttaaacccaaaatacctaatcttttcctaatacagtatgcccagtattttgctcttttccttagtcttatctgagtggcaggttttattttttaaaatctagatgtcaagttgaatgtgtaatttttttatacactgaatctgaaatatattgggtctactccttgccgtaattccttttagttttcagtggtgaaaaaggcaaaatttgtaatatagctattgctattccttattctgaaattcctgttcatcctaggaaatttcagcaaatgcagacaaatcactattcagagacattcactattaacagtttaacgta

SEQ ID NO: 192812 - DNA, 7218 bp, Homo sapiens
  Payload ID: 18059
  Gene Name: transient receptor potential cation channel, subfamily M, member 7
  ENST ID: ENST00000560955
  CDS Start-End: 239-5833
cgggcgcgggcgcgtccctgtggccagtcacccggaggagttggtcgcacaattatgaaagactcggcttctgctgctagcgccggagctgagttagttctgagaaggtttccctgggcgttccttgtccggcggcctctgctgccgcctccggagacgcttcccgatagatggctacaggccgcggaggaggaggaggtggagttgctgcccttccggagtccgccccgtgaggagaatgtcccagaaatcctggatagaaagcactttgaccaagagggaatgtgtatatattataccaagttccaaggaccctcacagatgccttccaggatgtcaaatttgtcagcaactcgtcaggtgtttttgtggtcgcttggtcaagcaacatgcttgttttactgcaagtcttgccatgaaatactcagatgtgaaattgggtgaccattttaatcaggcaatagaagaatggtctgtggaaaagcatacagaacagagcccaacggatgcttatggagtcataaattttcaagggggttctcattcctacagagctaagtatgtgaggctatcatatgacaccaaacctgaagtcattctgcaacttctgcttaaagaatggcaaatggagttacccaaacttgttatctctgtacatgggggcatgcagaaatttgagcttcacccacgaatcaagcagttgcttggaaaaggtcttattaaagctgcagttacaactggagcctggattttaactggaggagtaaacacaggtgtggcaaaacatgttggagatgccctcaaagaacatgcttccagatcatctcgaaagatttgcactatcggaatagctccatggggagtgattgaaaacagaaatgatcttgttgggagagatgtggttgctccttatcaaaccttattgaaccccctgagcaaattgaatgttttgaataatctgcattcccatttcatattggtggatgatggcactgttggaaagtatggggcggaagtcagactgagaagagaacttgaaaaaactattaatcagcaaagaattcatgctaggattggccagggtgtccctgtggtggcacttatatttgagggtgggccaaatgttatcctcacagttcttgaataccttcaggaaagcccccctgttccagtagttgtgtgtgaaggaacaggcagagctgcagatctgctagcgtatattcataaacaaacagaagaaggagggaatcttcctgatgcagcagagcccgatattatttccactatcaaaaaaacatttaactttggccagaatgaagcacttcatttatttcaaacactgatggagtgcatgaaaagaaaggagcttatcactgttttccatattgggtcagatgaacatcaagatatagatgtagcaatacttactgcactgctaaaaggtactaatgcatctgcatttgaccagcttatccttacattggcatgggatagagttgacattgccaaaaatcatgtatttgtttatggacagcagtggctggttggatccttggaacaagctatgcttgatgctcttgtaatggatagagttgcatttgtaaaacttcttattgaaaatggagtaagcatgcataaattccttaccattccgagactggaagaactttacaacactaaacaaggtccaactaatccaatgctgtttcatcttgttcgagacgtcaaacagggaaatcttcctccaggatataagatcactctgattgatataggacttgttattgaatatctcatgggaggaacctacagatgcacctatactaggaaacgttttcgattaatatataatagtcttggtggaaataatcggaggtctggccgaaatacctccagcagcactcctcagttgcgaaagagtcatgaatcttttggcaatagggcagataaaaaggaaaaaatgaggcataaccatttcattaagacagcacagccctaccgaccaaagattgatacagttatggaagaaggaaagaagaaaagaaccaaagatgaaattgtagacattgatgatccagaaaccaagcgctttccttatccacttaatgaacttttaatttgggcttgccttatgaagaggcaggtcatggcccgttttttatggcaacatggtgaagaatcaatggctaaagcattagttgcctgtaagatctatcgttcaatggcatatgaagcaaagcagagtgacctggtagatgatacttcagaagaactaaaacagtattccaatgattttggtcagttggccgttgaattattagaacagtccttcagacaagatgaaaccatggctatgaaattgctcacttatgaactgaagaactggagtaattcaacctgccttaagttagcagtttcttcaagacttagaccttttgtagctcacacctgtacacaaatgttgttatctgatatgtggatgggaaggctgaatatgaggaaaaattcctggtacaaggtcatactaagcattttagttccacctgccatattgctgttagagtataaaactaaggctgaaatgtcccatatcccacaatctcaagatgctcatcagatgacaatggatgacagcgaaaacaactttcagaacataacagaagagatccccatggaagtgtttaaagaagtacggattttggatagtaatgaaggaaagaatgagatggagatacaaatgaaatcaaaaaagcttccaattacgcgaaagttttatgccttttatcatgcaccaattgtaaaattctggtttaacacgttggcatatttaggatttctgatgctttatacatttgtggttcttgtacaaatggaacagttaccttcagttcaagaatggattgttattgcttatatttttacttatgccattgagaaagtccgtgagatctttatgtctgaagctgggaaagtaaaccagaagattaaagtatggtttagtgattacttcaacatcagtgatacaattgccataatttctttcttcattggatttggactaagatttggagcaaaatggaactttgcaaatgcatatgataatcatgtttttgtggctggaagattaatttactgtcttaacataatattttggtatgtgcgtttgctagattttctagctgtaaatcaacaggcaggaccttatgtaatgatgattggaaaaatggtggccaatatgttctacattgtagtgattatggctcttgtattacttagttttggtgttcccagaaaggcaatactttatcctcatgaagcaccatcttggactcttgctaaagatatagtttttcacccatactggatgatttttggtgaagtttatgcatacgaaattgatgtgtgtgcaaatgattctgttatccctcaaatctgtggtcctgggacgtggttgactccatttcttcaagcagtctacctctttgtacagtatatcattatggttaatcttcttattgcatttttcaacaatgtgtatttacaagtgaaggcaatttccaatattgtatggaagtaccagcgttatcattttattatggcttatcatgagaaaccagttctgcctcctccacttatcattcttagccatatagtttctctgttttgctgcatatgtaagagaagaaagaaagataagacttccgatggaccaaaacttttcttaacagaagaagatcaaaagaaacttcatgattttgaagagcagtgtgttgaaatgtatttcaatgaaaaagatgacaaatttcattctgggagtgaagagagaattcgtgtcacttttgaaagagtggaacagatgtgcattcagattaaagaagttggagatcgtgtcaactacataaaaagatcattacaatcattagattctcaaattggccatttgcaagatctttcagccctgacggtagatacattaaaaacactcactgcccagaaagcgtcggaagctagcaaagttcataatgaaatcacacgagaactgagcatttccaaacacttggctcaaaaccttattgatgatggtcctgtaagaccttctgtatggaaaaagcatggtgttgtaaatacacttagctcctctcttcctcaaggtgatcttgaaagtaataatccttttcattgtaatattttaatgaaagatgacaaagatccccagtgtaatatatttggtcaagacttacctgcagtaccccagagaaaagaatttaattttccagaggctggttcctcttctggtgccttattcccaagtgctgtttcccctccagaactgcgacagagactacatggggtagaactcttaaaaatatttaataaaaatcaaaaattaggcagttcatctactagcataccacatctgtcatccccaccaaccaaattttttgttagtacaccatctcagccaagttgcaaaagccacttggaaactggaaccaaagatcaagaaactgtttgctctaaagctacagaaggagataatacagaatttggagcatttgtaggacacagagatagcatggatttacagaggtttaaagaaacatcaaacaagataaaaatactatccaataacaatacttctgaaaacactttgaaacgagtgagttctcttgctggatttactgactgtcacagaacttccattcctgttcattcaaaacaagaaaaaatcagtagaaggccatctaccgaagacactcatgaagtagattccaaagcagctttaataccggattggttacaagatagaccatcaaacagagaaatgccatctgaagaaggaacattaaatggtctcacttctccatttaagccagctatggatacaaattactattattcagctgtggaaagaaataacttgatgaggttatcacagagcattccatttacacctgtgcctccaagaggggagcctgtcacagtgtatcgtttggaagagagttcacccaacatactaaataacagcatgtcttcttggtcacaactaggcctctgtgccaaaatagagtttttaagcaaagaggagatgggaggaggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagatctgaagaggaatgattatacgcctgataaaattatatttcctcaggatgagccttcagatttgaatcttcagcctggaaattccaccaaagaatcagaatcaactaattctgttcgtctgatgttataatattaatattactgaatcattggttttgcctgcacctcacagaaatgttactgtgtcacttttccctcgggaggaaattgtttggtaatatagaaaggtgtatgcaagttgaatttgctgactccagcacagttaaaaggtcaatattcttttgacctgattaatcagtcagaaagtccctataggatagagctggcagctgagaaattttaaaggtaattgataattagtatttataactttttaaagggctctttgtatagcagaggatctcatttgactttgttttgatgagggtgatgctctctcttatgtggtacaataccattaaccaaaggtaggtgtccatgcagattttattggcagctgttttattgccattcaactagggaaatgaagaaatcacgcagccttttggttaaatggcagtcaaaattttcctcagtgtatttagtgtgttcagtgatgatatcactggttcccaactagatgcttgttggccacgggaagggaaatgacttgttctaattctaggttcacagaggtatgagaagcctgaactgaagaccattttcaagagggacggtatttatgaatcagggttaggctccatatttaaagatagagccagtttttttttttaaatagaacccaaattgtgtaaaaatgttaattgggttttttaaacattgttttatcaagtcactgttaagtagaagaaagccatggtaaactgatacataacctaaattataaaagcagaaacctaactcactcgtcaagggaagttaccttttgaggaaagttaaagtacttttttccctatctgtatctatagcaacaacccagaacttacaaacttctccaaagattttattgattgttatatcaaatcagaatgtaaacatgaactcttgcatatatttaaaattgtgttggaacatttgaacatgaatgctgtttgtggtacttaagaaattaattcagttggattatcattatgtgatactggcagattgcagtgcaaccttatgccaataaaatgtaatttaacagccccagatattgttgaatattcaacaataacaagaaaagcttttcatctaagttttatgctttaattttttttctttttttttctttttcttttgtttccttggtactaattttaatttttatttggaagggagcagtataaagcttatttgtatttagtagtgtatctcatagatacagacaaggcaagagatgataagctgtttaaatagtgtttaatattgattgggggtggggagaaagaaaaagtgtattacttaaagatactatatacgttttgtatatcattaaatctttaaaagaaatgaaataaatttattgtttacaga

SEQ ID NO: 192813 - DNA, 830 bp, Homo sapiens
  Payload ID: 18059
  Gene Name: transient receptor potential cation channel, subfamily M, member 7
  ENST ID: ENST00000561267
  CDS Start-End: 1-703
aggtttacgaagagctgtcaaagtacagtgtacctggtcagaacatgatatcctcaaatcagggcatctttatattatcaaatcttttcttccagaggtggttaatacatggtcaagtatttacaaagaagatacagttctgcatctctgtctgagagaaattcaacaacagagagcagcacaaaagcttacgtttgcctttaatcaaatgaaacccaaatccataccatattctccaaggttccttgaagttttcctgctgtattgccattcagcaggacagtggtttgctgtggaagaatgtatgactggagaatttagaaaatacaacaataataatggagatgagattattccaactaatactctggaagagatcatgctagcctttagccactggacttacgaatatacaagaggggagttactggtacttgatttgcaaggtgttggtgaaaatttgactgacccatctgtgataaaagcagaagaaaagagatcctgtgatatggtttttggcccagcaaatctaggagaagatgcaattaaaaacttcagagcaaaacatcactgtaattcttgctgtagaaagcttaaacttccagagatgaggtctcactgtgttacccaggctggtcttgaactgacttcaagcaatcctcagtgcctcagcctcacaaagtgctgggattaccagtgctagccactgcatctggtcacaaatgttttttgaaaaatgtaaactagaatgagattttttaaaatattgaaagtgattcaggggaagatagtaaaagcacattaaaggtttcgtttctatttgggaaaaa

SEQ ID NO: 192814 - DNA, 5621 bp, Homo sapiens
  Payload ID: 18060
  Gene Name: transient receptor potential cation channel, subfamily M, member 8
  Uniprot ID: Q7Z2W7
  ENST ID: ENST00000324695
  CDS Start-End: 41-3355
aagaaaatcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagaattttctttctaagcaatggtatggagagatttcccgagacaccaagaactggaagattatcctgtgtctgtttattatacccttggtgggctgtggctttgtatcatttaggaagaaacctgtcgacaagcacaagaagctgctttggtactatgtggcgttcttcacctcccccttcgtggtcttctcctggaatgtggtcttctacatcgccttcctcctgctgtttgcctacgtgctgctcatggatttccattcggtgccacacccccccgagctggtcctgtactcgctggtctttgtcctcttctgtgatgaagtgagacagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatctatttattattaaaaccatttataaggctttttcataaatgtatagcaaataggaattattaacttgagcataagatatgagatacatgaacctgaactattaaaataaaatattatatttaacccttagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaatattatggatggtgaagggaatggtatagaattggagagattatcttactgaacacctgtagtcccagctttctctggaagtggtcgtatttgagcaggatgtgcacaaggcaattgaaatgcccataattagtttctcagctttgaatacactataaactcactggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattgtca

SEQ ID NO: 192815 - DNA, 904 bp, Homo sapiens
  Payload ID: 18060
  Gene Name: transient receptor potential cation channel, subfamily M, member 8
  ENST ID: ENST00000355722
  CDS Start-End: 115-693
ctgcctttctccaccagagactcttcctcagggaggacttggtgaattttattcaagcaaattttaagaaacgagaatgtgtcttctttaccaaagattccaaggccacgctcaatgaaatccttccttcctgtccacaccatcgtgcttatcagggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgaggtaccggtgggacaggaggaggtctgctaggtcacatggaagaaagaccatggcatgggcctgtggcctgaaccctggggctctgtgatggagccagccagatcatggggaagtctgcctttcaaggagtgcctttgggaccttaaaggaattgaaaacaaggatgacgtacctaattaactgctgggaaagagttaacaatgaatgttttgttcattaaaatgtgttctcagcaatctca

SEQ ID NO: 192816 - DNA, 722 bp, Homo sapiens
  Payload ID: 18060
  Gene Name: transient receptor potential cation channel, subfamily M, member 8
  Uniprot ID: Q7Z2W7
  ENST ID: ENST00000409625
  CDS Start-End: 124-621
ctcagggaggacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgaggtaccggtgggacaggaggaggtctgctaggtcacatggaagaaagaccatggcatgggcctgtggcctgaaccctggggctctgtgatggagccagccagatcatggggaagtctgcctttcaaggagtg

SEQ ID NO: 192817 - DNA, 2143 bp, Homo sapiens
  Payload ID: 18060
  Gene Name: transient receptor potential cation channel, subfamily M, member 8
  ENST ID: ENST00000439148
  CDS Start-End: 1-420
ggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaagcctgacttggctcagatggaaacagcttggaggaggcatttgctccctgaaccaacccccagggctgccccggagaccgcacttcagaagcacgcgcgtgaaacggagtccaacataacagagtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaa

SEQ ID NO: 192818 - DNA, 3348 bp, Homo sapiens
  Payload ID: 18060
  Gene Name: transient receptor potential cation channel, subfamily M, member 8
  ENST ID: ENST00000444298
  CDS Start-End: 34-1011
tcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaatcaagaagatttgggaggagaatttcagtgacatgaataacctgtgtacttagtgttggccttgacagtcaacctgccaaagagaagagttgacattaattcgggagacttaaagattgtaaccggcatatatattagaaagctatggccaacctatctgcattgagatgagctgtgatcatacacacacagattgcccccaaaccagatgtttccagaccacctaaggcccatttatatgccacctggggatgcaggccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaatttt

SEQ ID NO: 192819 - DNA, 5291 bp, Homo sapiens
  Payload ID: 18060
  Gene Name: transient receptor potential cation channel, subfamily M, member 8
  ENST ID: ENST00000433712
  CDS Start-End: 764-3025
aagaaaatcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggctatgcccagagccagcacatggaaggcacccagatcaaccaaagtgagaaatggaactacaagaaacacaccaaggaatttcctaccgacgcctttggggatattcagtttgagacactggggaagaaagggaagtatatacgtctgtcctgcgacacggacgcggaaatcctttacgagctgctgacccagcactggcacctgaaaacacccaacctggtcatttctgtgaccgggggcgccaagaacttcgccctgaagccgcgcatgcgcaagatcttcagccggctcatctacatcgcgcagtccaaaggtgcttggattctcacgggaggcacccattatggcctgatgaagtacatcggggaggtggtgagagataacaccatcagcaggagttcagaggagaatattgtggccattggcatagcagcttggggcatggtctccaaccgggacaccctcatcaggaattgcgatgctgagggctattttttagcccagtaccttatggatgacttcacaagagatccactgtatatcctggacaacaaccacacacatttgctgctcgtggacaatggctgtcatggacatcccactgtcgaagcaaagctccggaatcagctagagaagtatatctctgagcgcactattcaagattccaactatggtggcaagatccccattgtgtgttttgcccaaggaggtggaaaagagactttgaaagccatcaatacctccatcaaaaataaaattccttgtgtggtggtggaaggctcgggccagatcgctgatgtgatcgctagcctggtggaggtggaggatgccctgacatcttctgccgtcaaggagaagctggtgcgctttttaccccgcacggtgtcccggctgcctgaggaggagactgagagttggatcaaatggctcaaagaaattctcgaatgttctcacctattaacagttattaaaatggaagaagctggggatgaaattgtgagcaatgccatctcctacgctctatacaaagccttcagcaccagtgagcaagacaaggataactggaatgggcagctgaagcttctgctggagtggaaccagctggacttagccaatgatgagattttcaccaatgaccgccgatgggagtctgctgaccttcaagaagtcatgtttacggctctcataaaggacagacccaagtttgtccgcctctttctggagaatggcttgaacctacggaagtttctcacccatgatgtcctcactgaactcttctccaaccacttcagcacgcttgtgtaccggaatctgcagatcgccaagaattcctataatgatgccctcctcacgtttgtctggaaactggttgcgaacttccgaagaggcttccggaaggaagacagaaatggccgggacgagatggacatagaactccacgacgtgtctcctattactcggcaccccctgcaagctctcttcatctgggccattcttcagaataagaaggaactctccaaagtcatttgggagcagaccaggggctgcactctggcagccctgggagccagcaagcttctgaagactctggccaaagtgaagaacgacatcaatgctgctggggagtccgaggagctggctaatgagtacgagacccgggctgttgagctgttcactgagtgttacagcagcgatgaagacttggcagaacagctgctggtctattcctgtgaagcttggggtggaagcaactgtctggagctggcggtggaggccacagaccagcatttcatcgcccagcctggggtccagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagcttaatgatctcaagggtcttctgaaagagattgctaataaaatcaaataaaactgtatgaactctaatggagaaaaatctaattatagcaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggaggtgacaaggcagtctcttgctctcttggactcaccaggctcctattgaaggaaccacccccattcctaaatatgtgaaaagtcgcccaaaatgcaaccttgaaaggcactactgactttgttcttattggatactcctcttattatttttccattaaaaataatagctggctattatagaaaatttagaccatacagagatgtagaaagaacataaattgtccccattaccttaaggtaatcactgctaacaatttctggatggtttttcaagtctattttttttctatgtatgtctcaattctctttcaaaattttacagaatgttatcatactacatatatactttttatgtaagctttttcacttagtattttatcaaatatgtttttattatattcatagccttcttaaacattatatcaataattgcataataggcaacctctagcgattaccataattttgctcattgaaggctatctccagttgatcattgggatgagcatctttgtgcatgaatcctattgctgtatttgggaaaattttccaaggttagattccaataaatatctatttattattaaatattaaaatatctatttattattaaaaccatttataaggctttttcataaatgtatagcaaataggaattattaacttgagcataagatatgagatacatgaacctgaactattaaaataaaatattatatttaacccttagtttaagaagaagtcaatatgcttatttaaatattatggatggtgggcagatcacttgaggtcaggagttcgagaccagcctggccaacatggcaaaaccacatctctactaaaaataaaaaaattagctgggtgtggtggtgcactcctgtaatcccagctactcagaaggctgaggtacaagaattgctggaacctgggaggcggaggttgcagtgaaccaagattgcaccactgcactccagccggggtgacagagtgagactccgactgaaaataaataaataaataaataaataaataaataaatattatggatggtgaagggaatggtatagaattggagagattatcttactgaacacctgtagtcccagctttctctggaagtggtcgtatttgagcaggatgtgcacaaggcaattgaaatgcccataattagtttctcagctttgaatacactataaactcactggctgaaggaggaaattttagaaggaagctactaaaagatctaatttgaaaaactacaaaagcattaactaaaaaagtttattttccttttgtctgggcagtagtgaaaataactactcacaacattcactatgtttgcaaggaattaacacaaataaaagatgcctttttacttaaacaccaagacagaaaacttgcccaatactgagaagcaacttgcattagagagggaactgttaaatgttttcaacccagttcatctggtggatgtttttgcaggttactctgagaattttgcttatgaaaaatcattatttttagtgtagttcacaataatgtattgaacatacttctaatcaaaggtgctatgtccttgtgtatggtactaaatgtgtcctgtgtacttttgcacaactgagaatcctgcagcttggtttaatgagtgtgttcatgaaataaataatggaggaattgtca

SEQ ID NO: 192820 - DNA, 1592 bp, Homo sapiens
  Payload ID: 18060
  Gene Name: transient receptor potential cation channel, subfamily M, member 8
  ENST ID: ENST00000456930
  CDS Start-End: 1-1131
actgagtgttacagcagcgatgaagacttggcagaacagctgctggtctattcctgtgaagcttggggtggaagcaactgtctggagctggcggtggaggccacagaccagcatttcatcgcccagcctggggtccagtggtacgtaaatggggtgaattattttactgacctgtggaatgtgatggacacgctggggcttttttacttcatagcaggaattgtatttcggctccactcttctaataaaagctctttgtattctggacgagtcattttctgtctggactacattattttcactctaagattgatccacatttttactgtaagcagaaacttaggacccaagattataatgctgcagaggatgctgatcgatgtgttcttcttcctgttcctctttgcggtgtggatggtggcctttggcgtggccaggcaagggatccttaggcagaatgagcagcgctggaggtggatattccgttcggtcatctacgagccctacctggccatgttcggccaggtgcccagtgacgtggatggtaccacgtatgactttgcccactgcaccttcactgggaatgagtccaagccactgtgtgtggagctggatgagcacaacctgccccggttccccgagtggatcaccatccccctggtgtgcatctacatgttatccaccaacatcctgctggtcaacctgctggtcgccatgtttggctacacggtgggcaccgtccaggagaacaatgaccaggtctggaagttccagaggtacttcctggtgcaggagtactgcagccgcctcaatatccccttccccttcatcgtcttcgcttacttctacatggtggtgaagaagtgcttcaagtgttgctgcaaggagaaaaacatggagtcttctgtctgctgtttcaaaaatgaagacaatgagactctggcatgggagggtgtcatgaaggaaaactaccttgtcaagatcaacacaaaagccaacgacacctcagaggaaatgaggcatcgatttagacaactggatacaaagatcatattaaggaatgctgatgaacaattttgctatcgactactaaatgagagattttcagacccctgggtacatggtggatgattttaaatcaccctagtgtgctgagaccttgagaataaagtgtgtgattggtttcatacttgaagacggatataaaggaagaatatttcctttatgtgtttctccagaatggtgcctgtttctctctgtgtctcaatgcctgggactggaggttgatagtttaagtgtgttcttaccgcctcctttttcctttaatcttatttttgatgaacacatatataggagaacatctatcctatgaataagaacctggtcatgctttactcctgtattgttattttgttcatttccaattgattctctacttttcccttttttgtattatgtgactaattagttggcatattgttaaaagtctctcaaattaggccagattctaaaacatgctgcagcaagaggaccccgctctcttcaggaaaagtgttttcatttctcaggatgcttcttacctgtcagaggag

SEQ ID NO: 192821 - DNA, 2340 bp, Homo sapiens
  Payload ID: 18061
  Gene Name: transient receptor potential cation channel, subfamily V, member 1
  ENST ID: ENST00000310522
  CDS Start-End: 1-2340
atgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcgggaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtga

SEQ ID NO: 192822 - DNA, 4068 bp, Homo sapiens
  Payload ID: 18061
  Gene Name: transient receptor potential cation channel, subfamily V, member 1
  Uniprot ID: Q8NER1
  ENST ID: ENST00000399756
  CDS Start-End: 528-3047
ctgccgctcaccctattccagggacacagtctgcttggctcttctggactgagccatcctcatcaccgagatcctccctgaattcagcccacgacagccaccccggccgttttccttgttctgtgtggggagggaggcagcgcggtggttatcaacctcaccctgcagaggaggcacctgaggcccagagacgaggagggatgggtctaacccagaaccacagatggctctgagccgggggcctgtccaccctcccaggccgacgtcagtggccgcaggactgcctgggccctgctaggcctgctcacctctgaggcctctggggtgagaggttcagtcctggaaacacttcagttctagggggctgggggcagcagcaagttggagttttggggtaccctgcttcacagggcccttggcaaggagggcaggtggggtctaaggacaagcagtccttactttgggagtcaaccccggcgtggtggctgctgcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggccc

SEQ ID NO: 192823 - DNA, 4092 bp, Homo sapiens
  Payload ID: 18061
  Gene Name: transient receptor potential cation channel, subfamily V, member 1
  Uniprot ID: Q8NER1
  ENST ID: ENST00000399759
  CDS Start-End: 202-2721
gcagagtgtgcagtatagattcagcgtttgtcgactgactgaatgatagcacaatcccggctgcttcctgttggctgggtttggttggactgggacccgtcagaggaaaaggcaacgccgctgacaaagaacattgccgaaaggttcatgggaggctccggctaacaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatata

SEQ ID NO: 192824 - DNA, 2607 bp, Homo sapiens
  Payload ID: 18061
  Gene Name: transient receptor potential cation channel, subfamily V, member 1
  ENST ID: ENST00000425167
  CDS Start-End: 18-2570
cagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggttatcgagaatggaccaccgctgtccttcatggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggcctt

SEQ ID NO: 192825 - DNA, 2525 bp, Homo sapiens
  Payload ID: 18061
  Gene Name: transient receptor potential cation channel, subfamily V, member 1
  ENST ID: ENST00000576351
  CDS Start-End: 34-2523
gttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggagaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgagg

SEQ ID NO: 192826 - DNA, 4166 bp, Homo sapiens
  Payload ID: 18061
  Gene Name: transient receptor potential cation channel, subfamily V, member 1
  Uniprot ID: Q8NER1
  ENST ID: ENST00000572705
  CDS Start-End: 276-2795
ggctcaggcaggcctggcccagagtcacgctggcaaccacgagtttgggaagcagtcgtattctctctctctctctctctctctctctcagtatccatgacagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatata

SEQ ID NO: 192827 - DNA, 4105 bp, Homo sapiens
  Payload ID: 18061
  Gene Name: transient receptor potential cation channel, subfamily V, member 1
  Uniprot ID: Q8NER1
  ENST ID: ENST00000571088
  CDS Start-End: 215-2734
ccgaagggcgtccacagcgactcctgctagtgcagggcagctgctgccagggccgggcccgggaccccacggaggcggggagaccactcttctcccacacgagcccagctctcccttcgagtagcaaccgccttcaagctcacaagcacccgtgggcctggggtgtgcctgcgtctagctggttgcacactgggccacagaggatccagcaaggatgaagaaatggagcagcacagacttgggggcagctgcggacccactccaaaaggacacctgcccagaccccctggatggagaccctaactccaggccacctccagccaagccccagctctccacggccaagagccgcacccggctctttgggaagggtgactcggaggaggctttcccggtggattgccctcacgaggaaggtgagctggactcctgcccgaccatcacagtcagccctgttatcaccatccagaggccaggagacggccccaccggtgccaggctgctgtcccaggactctgtcgccgccagcaccgagaagaccctcaggctctatgatcgcaggagtatctttgaagccgttgctcagaataactgccaggatctggagagcctgctgctcttcctgcagaagagcaagaagcacctcacagacaacgagttcaaagaccctgagacagggaagacctgtctgctgaaagccatgctcaacctgcacgacggacagaacaccaccatccccctgctcctggagatcgcgcggcaaacggacagcctgaaggagcttgtcaacgccagctacacggacagctactacaagggccagacagcactgcacatcgccatcgagagacgcaacatggccctggtgaccctcctggtggagaacggagcagacgtccaggctgcggcccatggggacttctttaagaaaaccaaagggcggcctggattctacttcggtgaactgcccctgtccctggccgcgtgcaccaaccagctgggcatcgtgaagttcctgctgcagaactcctggcagacggccgacatcagcgccagggactcggtgggcaacacggtgctgcacgccctggtggaggtggccgacaacacggccgacaacacgaagtttgtgacgagcatgtacaatgagattctgatgctgggggccaaactgcacccgacgctgaagctggaggagctcaccaacaagaagggaatgacgccgctggctctggcagctgggaccgggaagatcggggtcttggcctatattctccagcgggagatccaggagcccgagtgcaggcacctgtccaggaagttcaccgagtgggcctacgggcccgtgcactcctcgctgtacgacctgtcctgcatcgacacctgcgagaagaactcggtgctggaggtgatcgcctacagcagcagcgagacccctaatcgccacgacatgctcttggtggagccgctgaaccgactcctgcaggacaagtgggacagattcgtcaagcgcatcttctacttcaacttcctggtctactgcctgtacatgatcatcttcaccatggctgcctactacaggcccgtggatggcttgcctccctttaagatggaaaaaactggagactatttccgagttactggagagatcctgtctgtgttaggaggagtctacttctttttccgagggattcagtatttcctgcagaggcggccgtcgatgaagaccctgtttgtggacagctacagtgagatgcttttctttctgcagtcactgttcatgctggccaccgtggtgctgtacttcagccacctcaaggagtatgtggcttccatggtattctccctggccttgggctggaccaacatgctctactacacccgcggtttccagcagatgggcatctatgccgtcatgatagagaagatgatcctgagagacctgtgccgtttcatgtttgtctacatcgtcttcttgttcgggttttccacagcggtggtgacgctgattgaagacgggaagaatgactccctgccgtctgagtccacgtcgcacaggtggcgggggcctgcctgcaggccccccgatagctcctacaacagcctgtactccacctgcctggagctgttcaagttcaccatcggcatgggcgacctggagttcactgagaactatgacttcaaggctgtcttcatcatcctgctgctggcctatgtaattctcacctacatcctcctgctcaacatgctcatcgccctcatgggtgagactgtcaacaagatcgcacaggagagcaagaacatctggaagctgcagagagccatcaccatcctggacacggagaagagcttccttaagtgcatgaggaaggccttccgctcaggcaagctgctgcaggtggggtacacacctgatggcaaggacgactaccggtggtgcttcagggtggacgaggtgaactggaccacctggaacaccaacgtgggcatcatcaacgaagacccgggcaactgtgagggcgtcaagcgcaccctgagcttctccctgcggtcaagcagagtttcaggcagacactggaagaactttgccctggtcccccttttaagagaggcaagtgctcgagataggcagtctgctcagcccgaggaagtttatctgcgacagttttcagggtctctgaagccagaggacgctgaggtcttcaagagtcctgccgcttccggggagaagtgaggacgtcacgcagacagcactgtcaacactgggccttaggagaccccgttgccacggggggctgctgagggaacaccagtgctctgtcagcagcctggcctggtctgtgcctgcccagcatgttcccaaatctgtgctggacaagctgtgggaagcgttcttggaagcatggggagtgatgtacatccaaccgtcactgtccccaagtgaatctcctaacagactttcaggtttttactcactttactaaacagtttggatggtcagtctctactgggacatgttaggcccttgttttctttgattttattcttttttttgagacagaatttcactcttctcacccaggctggaatgcagtggcacaattttggctccctgcaacctccgcctcctggattccagcaattctcctgcctcggcttcccaagtagctgggattacaggcacgtgccaccatgtctggctaattttttgtatttttttaatagatatggggtttcgccatgttggccaggctggtctcgaactcctgacctcaggtgatccgcccacctcggcctcccaaagtgctgggattacaggtgtgagcctccacacctggctgttttctttgattttattctttttttttttttctgtgagacagagtttcactcttgttgcccaggctggagtgcagtggtgtgatcttggctcactgcaacttctgcctcccgggttcaagcgattcttctgcttcagtctcccaagtagcttggattacaggtgagcactaccacgcccggctaatttttgtatttttaatagagacggggtttcaccatgttggccaggctggtctcgaactcttgacctcaggtgatctgcccgccttggcctcccaaagtgctgggattacaggtgtgagccgctgcgctcggccttctttgattttatattattaggagcaaaagtaaatgaagcccaggaaaacacctttgggaacaaactcttcctttgatggaaaatgcagaggcccttcctctctgtgccgtgcttgctcctcttacctgcccgggtggtttgggggtgttggtgtttcctccctggagaagatgggggaggctgtcccactcccagctctggcagaatcaagctgttgcagcagtgccttcttcatccttccttacgatcaatcacagtctccagaagatcagctcaattgctgtgcaggttaaaactacagaaccacatcccaaaggtacctggtaagaatgtttgaaagatcttccatttctaggaaccccagtcctgcttctccgcaatggcacatgcttccactccatccatactggcatcctcaaataaacagatatgtatacatatata

SEQ ID NO: 192828 - DNA, 2808 bp, Homo sapiens
  Payload ID: 18062
  Gene Name: transient receptor potential cation channel, subfamily V, member 2
  Uniprot ID: Q9Y5S1
  ENST ID: ENST00000338560
  CDS Start-End: 400-2694
gattcgcagcagggtgtgtccagatggtcagtctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggagtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccgcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaagcaggccgcccctcacctgaaagcggaggttggaaactccatgctgctgacgggccacatccttatcctgctaggggggatctacctcctcgtgggccagctgtggtacttctggcggcgccacgtgttcatctggatctcgttcatagacagctactttgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtcatcctgcgggacctgctgcgcttccttctgatctacttagtcttccttttcggcttcgctgtagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactaa

SEQ ID NO: 192829 - DNA, 796 bp, Homo sapiens
  Payload ID: 18062
  Gene Name: transient receptor potential cation channel, subfamily V, member 2
  ENST ID: ENST00000455666
  CDS Start-End: 1-796
agatttctcattaggtgtgccttcttggtggtgtctgatatgtttcaacattgggcccagcgttgggcccagtcagccggatccaaaccgatttgaccgagatcggctcttcaatgcggtctcccggggtgtccccgaggatctggctggacttccagagtacctgagcaagaccagcaagtacctcaccgactcggaatacacagagggctccacaggtaagacgtgcctgatgaaggctgtgctgaaccttaaggacggagtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgag

SEQ ID NO: 192830 - DNA, 473 bp, Homo sapiens
  Payload ID: 18062
  Gene Name: transient receptor potential cation channel, subfamily V, member 2
  ENST ID: ENST00000577277
  CDS Start-End: 1-232
tgaaatcctcttcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactaa

SEQ ID NO: 192831 - DNA, 586 bp, Homo sapiens
  Payload ID: 18062
  Gene Name: transient receptor potential cation channel, subfamily V, member 2
  ENST ID: ENST00000581560
  CDS Start-End: 1-417
gaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcaggaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactaa

SEQ ID NO: 192832 - DNA, 530 bp, Homo sapiens
  Payload ID: 18062
  Gene Name: transient receptor potential cation channel, subfamily V, member 2
  ENST ID: ENST00000580788
  CDS Start-End: 1-289
caacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaactaa

SEQ ID NO: 192833 - DNA, 512 bp, Homo sapiens
  Payload ID: 18062
  Gene Name: transient receptor potential cation channel, subfamily V, member 2
  ENST ID: ENST00000577865
  CDS Start-End: 1-273
gccctcatgagcgagaccgtcaacagtgtcgccactgacagctggagcatctggaagctgcagaaagccatctctgtcctggagatggagaatggctattggtggtgcaggaagaagcagcgggcaggtgtgatgctgaccgttggcactaagccagatggcagccccgatgagcgctggtgcttcaggcaaacctcagagctgctctgttgccctcagggtggaggaggtgaactgggcttcatgggagcagacgctgcctacgctgtgtgaggacccgtcaggggcaggtgtccctcgaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaact

SEQ ID NO: 192834 - DNA, 3235 bp, Homo sapiens
  Payload ID: 18063
  Gene Name: transient receptor potential cation channel, subfamily V, member 3
  Uniprot ID: Q8NET8
  ENST ID: ENST00000301365
  CDS Start-End: 133-2508
tccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaa

SEQ ID NO: 192835 - DNA, 5050 bp, Homo sapiens
  Payload ID: 18063
  Gene Name: transient receptor potential cation channel, subfamily V, member 3
  ENST ID: ENST00000381913
  CDS Start-End: 1-1019
agggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaagtttgtgattttaaaagtggagacagactgggggctttggggctggatgtaagtattatatatttggcctcagggtgcccagagcaagacaaaaagcttttcttcacacacacaaaagtctgcatgagacactccgggcaagtcctgctgggccgccgcgatctgggtgaaaggtcctggctcttttcctcgtcctgacctcacagtagcgcgtgcctgtgtgctgggatcgtggctttcgctgaagcagaaatagcagctgctcgatcgatatcatcttggaactcagcagttagtcgcatacctcagtatgtctcagtgggggaatttaacaaaatgcctcaactgctttggtacgaagtattttttttttaattttaactgtgaattttgaagctgaaggggaagcttgtgagagaaaagcatttgccaagactttgagcttatttttaggtcctcgtcctctgatgttctctttctgaaatgacacggagtcagtctggggggcagaggtgaagtggagacggaaggattttccaggtgactggggccgaaaccaccagaaaatccactctgccgccgttatctggtgaaaggattcatgtaaaaatgttcgaggtggaattataaaaatagtaaccataaatgttaatcttaaatggcagaaatagaaatttggccttcagataacatggcgatagataagttcatctggcttgaggcaaactgaagagtcggggcctagcagtgcactctgggccagtttctctgccctgggccactctgtgtgccagactagctggacagatagagactttgtgcccctgatggggccgattggggagaggtgggctggggtgtgtgaggcttcacaatccacagcagcccctgccctcccagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctacccgcattaagcctgaacagacatcttggtctgaaaggaagtggtttggattcatgatgccaagctccacactatggagctgggaattccagaattgctttgactcagatattaatggagaaagtcatatccattaatggataaagccgtatctgttatggataaagccgtatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggatggaatttgttggcaagaccattttctgtattggatattcttcccaacagtgtccaccccaaaaggctttcagccaaaacgtctgagcctaggtaggtttaccaagggaagccataagtcaagaagcatcagagtgaaaaggagcacttccttcattttacgcccagaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgtta

SEQ ID NO: 192836 - DNA, 2726 bp, Homo sapiens
  Payload ID: 18063
  Gene Name: transient receptor potential cation channel, subfamily V, member 3
  ENST ID: ENST00000571139
  CDS Start-End: 95-262
gcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtagacacagggttttgccgcattggcctcaaactcctgacctcaactgatctgcccactttgacctcccagagggctgggattacaggcatgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtcc

SEQ ID NO: 192837 - DNA, 2744 bp, Homo sapiens
  Payload ID: 18063
  Gene Name: transient receptor potential cation channel, subfamily V, member 3
  ENST ID: ENST00000573539
  CDS Start-End: 95-262
gcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtagacacagggttttgccgcattggcctcaaactcctgacctcaactgatctgcccactttgacctcccagagggctgggattacaggcatgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaaggttctcactctgttgggcaggctggagtgcagtggcgcgaccacgactcgctgcagccttgacctccctgggctcagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtcc

SEQ ID NO: 192838 - DNA, 2937 bp, Homo sapiens
  Payload ID: 18063
  Gene Name: transient receptor potential cation channel, subfamily V, member 3
  Uniprot ID: Q8NET8
  ENST ID: ENST00000572519
  CDS Start-End: 133-2430
tccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacaggtactgtcgctgtgaggtgacatggtgtccgctcctgtctcagaccatgtaaccttgggcagatcaagtctaagggtcctgactttccccatctgtcaaatgggagggttgaatggaaatgcttcttaggtctcttccagctctgacttttagaaccctagttggcacaacttttaaaatggcgtagccctaagccatagaaacacatcatgcaggccgggcgcggtggctcgtgcctgtaatcccagcactttgggaggacgagtcgggtgaatcacctgaggtcaggagtttgagaccagcctggccaacatggtgacaccttgtctctactaaagatacaaaaattagccgaacgtggtggcaggtgcctataatcccagctactcgagaggctgagtcaggagaattgcttgaacctgggaggtggaggttgcagtgagctgagatcacaccactgcactgcagcctgggtgacaagagggaaactccatctcaaaaaagaaaaaaaagaaaaagaaaaaaga

SEQ ID NO: 192839 - DNA, 1621 bp, Homo sapiens
  Payload ID: 18063
  Gene Name: transient receptor potential cation channel, subfamily V, member 3
  ENST ID: ENST00000577016
  CDS Start-End: 1-440
atgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaa

SEQ ID NO: 192840 - DNA, 2766 bp, Homo sapiens
  Payload ID: 18063
  Gene Name: transient receptor potential cation channel, subfamily V, member 3
  Uniprot ID: Q8NET8
  ENST ID: ENST00000576742
  CDS Start-End: 323-2695
ccacaacttcgatcttggcacctgcggcctcccctgccttttctccggtggggatgaggctgctgtgtgggtgtgggggtgactcacacgggccacgtgggtgggcgggtgctgcagctgtggctggtgggcgtggcctgcctggcgccgagggcaggtggctcagccagttctgcctctgacgcctcattccagccatccctctgcctgcaatgagagcttcccgccgcctcagccacagtcccacccgggggccttgggccccagacatgcggtgatctcagggcaagggttgccacgaccacccagaacctcaccagccatgaaagcccaccccaaggagatggtgcctctcatgggcaagagagttgctgcccccagtgggaaccctgccatcctgccagagaagaggccggcggagatcacccccacaaagaagagtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcaga

SEQ ID NO: 192841 - DNA, 5742 bp, Homo sapiens
  Payload ID: 18063
  Gene Name: transient receptor potential cation channel, subfamily V, member 3
  ENST ID: ENST00000616411
  CDS Start-End: 1-2328
atgagccaccacacctggcctagcccagctttgaatctggactttgctacctatctgctgcgtgaccttggtgcacacttcttcctggagatagaagggtttgaacccaaccccacagttgccaagacctctcctcctgtcttctccaagcccatggattccaacatccggcagtgcatctctggtaactgtgatgacatggactccccccagtctcctcaggatgatgtgacagagaccccatccaatcccaacagccccagtgcacagctggccaaggaagagcagaggaggaaaaagaggcggctgaagaagcgcatctttgcagccgtgtctgagggctgcgtggaggagttggtagagttgctggtggagctgcaggagctttgcaggcggcgccatgatgaggatgtgcctgacttcctcatgcacaagctgacggcctccgacacggggaagacctgcctgatgaaggccttgttaaacatcaaccccaacaccaaggagatagtgcggatcctgcttgcctttgctgaagagaacgacatcctgggcaggttcatcaacgccgagtacacagaggaggcctatgaagggcagacggcgctgaacatcgccatcgagcggcggcagggggacatcgcagccctgctcatcgccgccggcgccgacgtcaacgcgcacgccaagggggccttcttcaaccccaagtaccaacacgaaggcttctacttcggtgagacgcccctggccctggcagcatgcaccaaccagcccgagattgtgcagctgctgatggagcacgagcagacggacatcacctcgcgggactcacgaggcaacaacatccttcacgccctggtgaccgtggccgaggacttcaagacgcagaatgactttgtgaagcgcatgtacgacatgatcctactgcggagtggcaactgggagctggagaccactcgcaacaacgatggcctcacgccgctgcagctggccgccaagatgggcaaggcggagatcctgaagtacatcctcagtcgtgagatcaaggagaagcggctccggagcctgtccaggaagttcaccgactgggcgtacggacccgtgtcatcctccctctacgacctcaccaacgtggacaccaccacggacaactcagtgctggaaatcactgtctacaacaccaacatcgacaaccggcatgagatgctgaccctggagccgctgcacacgctgctgcatatgaagtggaagaagtttgccaagcacatgttctttctgtccttctgcttttatttcttctacaacatcaccctgaccctcgtctcgtactaccgcccccgggaggaggaggccatcccgcaccccttggccctgacgcacaagatggggtggctgcagctcctagggaggatgtttgtgctcatctgggccatgtgcatctctgtgaaagagggcattgccatcttcctgctgagaccctcggatctgcagtccatcctctcggatgcctggttccactttgtcttttttatccaagctgtgcttgtgatactgtctgtcttcttgtacttgtttgcctacaaagagtacctcgcctgcctcgtgctggccatggccctgggctgggcgaacatgctctactatacgcggggtttccagtccatgggcatgtacagcgtcatgatccagaaggtcattttgcatgatgttctgaagttcttgtttgtatatatcgtgtttttgcttggatttggagtagccttggcctcgctgatcgagaagtgtcccaaagacaacaaggactgcagctcctacggcagcttcagcgacgcagtgctggaactcttcaagctcaccataggcctgggtgacctgaacatccagcagaactccaagtatcccattctctttctgttcctgctcatcacctatgtcatcctcacctttgttctcctcctcaacatgctcattgctctgatgggcgagactgtggagaacgtctccaaggagagcgaacgcatctggcgcctgcagagagccaggaccatcttggagtttgagaaaatgttaccagaatggctgaggagcagattccggatgggagagctgtgcaaagtggccgaggatgatttccgactgtgtttgcggatcaatgaggtgaagtggactgaatggaagacgcacgtctccttccttaacgaagacccggggcctgtaagacgaacagcagatttcaacaaaatccaagattcttccaggaacaacagcaaaaccactctcaatgcatttgaagaagtcgaggaattcccggaaacctcggtgtagaagcggaacccagagctggtgtgcgcgtgcgctgtctggcgctgcaggcggagtcaccgactctgtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtaagctggatatcctgggggaggaggggaatgcgctctggaaacacccttccggaacccttcggggaaaaggagaccatccttggagtgaacgtcccctgacaccccaaggttcaaactgtctcaagctgagagatgtttttagtagcagaattaacacagggttttaacttgcaatacggaaaagacatttcagttgagaatgaaaattactacaatgaagtttgtgattttaaaagtggagacagactgggggctttggggctggatgtaagtattatatatttggcctcagggtgcccagagcaagacaaaaagcttttcttcacacacacaaaagtctgcatgagacactccgggcaagtcctgctgggccgccgcgatctgggtgaaaggtcctggctcttttcctcgtcctgacctcacagtagcgcgtgcctgtgtgctgggatcgtggctttcgctgaagcagaaatagcagctgctcgatcgatatcatcttggaactcagcagttagtcgcatacctcagtatgtctcagtgggggaatttaacaaaatgcctcaactgctttggtacgaagtattttttttttaattttaactgtgaattttgaagctgaaggggaagcttgtgagagaaaagcatttgccaagactttgagcttatttttaggtcctcgtcctctgatgttctctttctgaaatgacacggagtcagtctggggggcagaggtgaagtggagacggaaggattttccaggtgactggggccgaaaccaccagaaaatccactctgccgccgttatctggtgaaaggattcatgtaaaaatgttcgaggtggaattataaaaatagtaaccataaatgttaatcttaaatggcagaaatagaaatttggccttcagataacatggcgatagataagttcatctggcttgaggcaaactgaagagtcggggcctagcagtgcactctgggccagtttctctgccctgggccactctgtgtgccagactagctggacagatagagactttgtgcccctgatggggccgattggggagaggtgggctggggtgtgtgaggcttcacaatccacagcagcccctgccctcccagctgacccagggagtaatcgcgtgctctaagccacagtggtcggggctgggcatgggcctctggagaagagaagatttgaggagaactgtcctagaggcaggaggagcagatgtgtttcagaatgggcagaattaggaaattgagaaagattttggctcaacagaatccagcaactgctccagatgttggagatgtttaagcagaagctggttgcgcacttaatgaggaatgttgttgaaaatggtcattggaagaagtttaaggtcccttttagcctggagattgtacaaatcagcattccacatctggagttagctacccgcattaagcctgaacagacatcttggtctgaaaggaagtggtttggattcatgatgccaagctccacactatggagctgggaattccagaattgctttgactcagatattaatggagaaagtcatatccattaatggataaagccgtatctgttatggataaagccgtatccagagttgctttgactcggatgttaatggataaagccaattattgatttctatttgcctaacctgccagcttttgtccaagtggggaatggagagccatagggatgtttgtcatctcacatgttttggtgatctgctgtctgtgggtctggatggaatttgttggcaagaccattttctgtattggatattcttcccaacagtgtccaccccaaaaggctttcagccaaaacgtctgagcctaggtaggtttaccaagggaagccataagtcaagaagcatcagagtgaaaaggagcacttccttcattttacgcccagaggctaatgctccgagaggaatgtgtacttgggcaaagtcatgcaggaaggtcatatcagagctgtggaggctggagtgtcctgattcttggaccacagatgtctccctgagccattatttatttatttttaaaaagcacagttattccatcattttgagtctttgtatttcgcttatattggggggcaggactattttctcaggtgtctcatttggcagtcaacattgtcccctatgttccctatgactagttgaaaattcaagtgtgcccacaggggtgcacaaaaccacacccatgcacacacacaccctcagcccccacacacaccccgttgaacccgtgggtctatcaggacatcctaaaactccgtgattgacatttcagtaatttcaggggaaggtgttttccagggatggggtctcccaggttcagatagtgcctttggctgcaaatgctcctttagctaaacttttcctcaggaagaattcattattctagacattatgtgatatatctgttaggaataaaaggtgcttaaccttcctccctgggatgtgggagaaggtgctggaggttgtactgtgaagtcttcaggctcttagaaggctccagcctgagagagccctttattattgacattcctgtccttcctcaaggcctggtgacctgtgacctttcgctctgggcagggcccaggtagatgggccgtcatccgggcctgtaagccgtacttgatttctgcattgatttacatattttttactgtgatcttggttccaaacacagaatcgtcaccccattctcccttgaatgtgccggatccttgtaaattctcatttacctacttgttcttagtgtgtatgtgtgtgcgaaactctatgttcaagaaagaaatcatacaaagagtaagaacatgtttgtgccattgaagaaatggttttttgatttctaataaatatttgttttgcctcgtt

SEQ ID NO: 192842 - DNA, 3233 bp, Homo sapiens
  Payload ID: 18064
  Gene Name: transient receptor potential cation channel, subfamily V, member 4
  Uniprot ID: Q9HBA0
  ENST ID: ENST00000261740
  CDS Start-End: 84-2699
gggattcaggaagcgcggatctcccggccgccggcgcccagccgtcccggaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtgga

SEQ ID NO: 192843 - DNA, 3247 bp, Homo sapiens
  Payload ID: 18064
  Gene Name: transient receptor potential cation channel, subfamily V, member 4
  Uniprot ID: Q9HBA0
  ENST ID: ENST00000418703
  CDS Start-End: 96-2711
ggggcttcctggagcccccgcccctggccgggttctgcctgactcccctttcattcccttgcaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagtgccttctggggtgtccccccacaccctgctttggccccagaggcgagggaccagtggaggtgccagggaggccccaggaccctgtggtcccctggctctgcctccccaccctggggtgggggctcccggccacctgtcttgctcctatggagtcacataagccaacgccagagcccctccacctcaggccccagcccctgcctctccattatttatttgctctgctctcaggaagcgacgtgacccctgccccagctggaacctggcagaggccttaggaccccgttccaagtgcactgcccggccaagccccagcctcagcctgcgcctgagctgcatgcgccaccatttttggcagcgtggcagctttgcaaggggctggggccctcggcgtggggccatgccttctgtgtgttctgtagtgtctgggatttgccggtgctcaataaatgtttattcattgacggtggaga

SEQ ID NO: 192844 - DNA, 2804 bp, Homo sapiens
  Payload ID: 18064
  Gene Name: transient receptor potential cation channel, subfamily V, member 4
  ENST ID: ENST00000538125
  CDS Start-End: 84-1742
gggattcaggaagcgcggatctcccggccgccggcgcccagccgtcccggaggctgagcagtgcagacgggcctggggcaggcatggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctagtgagtagaggtccctgggccggcagcttctgggtgaggaagcttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctagggactgcagcccagccccagcttctctgcccactcatttctagtccagccgcatttcagcagt

SEQ ID NO: 192845 - DNA, 2475 bp, Homo sapiens
  Payload ID: 18064
  Gene Name: transient receptor potential cation channel, subfamily V, member 4
  Uniprot ID: Q9HBA0
  ENST ID: ENST00000541794
  CDS Start-End: 1-2475
atggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 192846 - DNA, 2436 bp, Homo sapiens
  Payload ID: 18064
  Gene Name: transient receptor potential cation channel, subfamily V, member 4
  Uniprot ID: Q9HBA0
  ENST ID: ENST00000537083
  CDS Start-End: 1-2436
atggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 192847 - DNA, 2295 bp, Homo sapiens
  Payload ID: 18064
  Gene Name: transient receptor potential cation channel, subfamily V, member 4
  Uniprot ID: Q9HBA0
  ENST ID: ENST00000544971
  CDS Start-End: 1-2295
atggcggattccagcgaaggcccccgcgcggggcccggggaggtggctgagctccccggggatgagagtggcaccccaggtggggaggcttttcctctctcctccctggccaatctgtttgagggggaggatggctccctttcgccctcaccggctgatgccagtcgccctgctggcccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 192848 - DNA, 2514 bp, Homo sapiens
  Payload ID: 18064
  Gene Name: transient receptor potential cation channel, subfamily V, member 4
  Uniprot ID: Q9HBA0
  ENST ID: ENST00000536838
  CDS Start-End: 1-2514
atggcggattccagcgaaggcccccgcgcggggcccggggaggtggctgagctccccggggatgagagtggcaccccaggcgatgggcgaccaaatctgcgcatgaagttccagggcgccttccgcaagggggtgcccaaccccatcgatctgctggagtccaccctatatgagtcctcggtggtgcctgggcccaagaaagcacccatggactcactgtttgactacggcacctatcgtcaccactccagtgacaacaagaggtggaggaagaagatcatagagaagcagccgcagagccccaaagcccctgcccctcagccgccccccatcctcaaagtcttcaaccggcctatcctctttgacatcgtgtcccggggctccactgctgacctggacgggctgctcccattcttgctgacccacaagaaacgcctaactgatgaggagtttcgagagccatctacggggaagacctgcctgcccaaggccttgctgaacctgagcaatggccgcaacgacaccatccctgtgctgctggacatcgcggagcgcaccggcaacatgagggagttcattaactcgcccttccgtgacatctactatcgaggtcagacagccctgcacatcgccattgagcgtcgctgcaaacactacgtggaacttctcgtggcccagggagctgatgtccacgcccaggcccgtgggcgcttcttccagcccaaggatgaggggggctacttctactttggggagctgcccctgtcgctggctgcctgcaccaaccagccccacattgtcaactacctgacggagaacccccacaagaaggcggacatgcggcgccaggactcgcgaggcaacacagtgctgcatgcgctggtggccattgctgacaacacccgtgagaacaccaagtttgttaccaagatgtacgacctgctgctgctcaagtgtgcccgcctcttccccgacagcaacctggaggccgtgctcaacaacgacggcctctcgcccctcatgatggctgccaagacgggcaagattgggatctttcagcacatcatccggcgggaggtgacggatgaggacacacggcacctgtcccgcaagttcaaggactgggcctatgggccagtgtattcctcgctttatgacctctcctccctggacacgtgtggggaagaggcctccgtgctggagatcctggtgtacaacagcaagattgagaaccgccacgagatgctggctgtggagcccatcaatgaactgctgcgggacaagtggcgcaagttcggggccgtctccttctacatcaacgtggtctcctacctgtgtgccatggtcatcttcactctcaccgcctactaccagccgctggagggcacaccgccgtacccttaccgcaccacggtggactacctgcggctggctggcgaggtcattacgctcttcactggggtcctgttcttcttcaccaacatcaaagacttgttcatgaagaaatgccctggagtgaattctctcttcattgatggctccttccagctgctctacttcatctactctgtcctggtgatcgtctcagcagccctctacctggcagggatcgaggcctacctggccgtgatggtctttgccctggtcctgggctggatgaatgccctttacttcacccgtgggctgaagctgacggggacctatagcatcatgatccagaagattctcttcaaggaccttttccgattcctgctcgtctacttgctcttcatgatcggctacgcttcagccctggtctccctcctgaacccgtgtgccaacatgaaggtgtgcaatgaggaccagaccaactgcacagtgcccacttacccctcgtgccgtgacagcgagaccttcagcaccttcctcctggacctgtttaagctgaccatcggcatgggcgacctggagatgctgagcagcaccaagtaccccgtggtcttcatcatcctgctggtgacctacatcatcctcacctttgtgctgctcctcaacatgctcattgccctcatgggcgagacagtgggccaggtctccaaggagagcaagcacatctggaagctgcagtgggccaccaccatcctggacattgagcgctccttccccgtattcctgaggaaggccttccgctctggggagatggtcaccgtgggcaagagctcggacggcactcctgaccgcaggtggtgcttcagggtggatgaggtgaactggtctcactggaaccagaacttgggcatcatcaacgaggacccgggcaagaatgagacctaccagtattatggcttctcgcataccgtgggccgcctccgcagggatcgctggtcctcggtggtaccccgcgtggtggaactgaacaagaactcgaacccggacgaggtggtggtgcctctggacagcatggggaacccccgctgcgatggccaccagcagggttacccccgcaagtggaggactgatgacgccccgctctag

SEQ ID NO: 192849 - DNA, 2952 bp, Homo sapiens
  Payload ID: 18065
  Gene Name: transient receptor potential cation channel, subfamily V, member 5
  ENST ID: ENST00000265310
  CDS Start-End: 350-2539
ctcagctctgcaaagagctcctccccctccaggaaaagcacttctccccaggcagggcggtcagtcccctcagcgcacctgcatgcacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccatagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctatgatggacatggggaccacctgcagcccctggaccttgtgcccaatcaccagggtctcacccccttcaagctggctggagtggagggtaacactgtgatgttccagcacctgatgcagaagcggaggcacatccagtggacgtatggacccctgacctccattctctacgacctcacggagatcgactcctggggagaggagctgtccttcctggagcttgtggtctcctctgataaacgagaggctcgccaaattctggaacagaccccagtgaaggagctggtgagcttcaagtggaacaagtatggccggccgtacttctgcatcctggctgccttgtacctgctctacatgatctgctttactacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatcatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccgcgttctatatcattttccagacagaggacccaaccagtctggggcaattctatgactaccccatggcactgttcaccacctttgagctttttctcactgttattgatgcacctgccaactacgacgtggacttgcccttcatgttcagcattgtcaacttcgccttcaccatcattgccacactgctcatgctcaacttgttcatcgccatgatgggcgacacccactggagggtggcccaggagagggatgagctctggagggcccaggtcgtggccaccacagtgatgctggagcggaagctgcctcgctgcctgtggcctcgctccgggatctgtgggtgcgaattcgggctgggggaccgctggttcctgcgggttgagaaccacaatgatcagaatcctctgcgagtgcttcgctatgtggaagtgttcaagaactcagacaaggaggatgaccaggagcatccatctgagaaacagccctctggggctgagagtgggactctagccagagcctctttggctcttccaacttcctccctgtcccggaccgcgtcccagagcagcagtcaccgaggctgggagatccttcgtcaaaacaccctggggcacttgaatcttggactgaaccttagtgagggggatggagaggaggtctaccatttttgattaacatcgctatcactcttgaccttactcccggttggcctgggggcggggacagagacggagacctctgcctatgcaagtgtctaacttctgtgcctgttaatcatgggagggtgagacagaacaatccctaaagggtcatgcctcacacttcacatcagaatttctggcaatgggcaatggtcatcgattgtctcacgtattttctgggctcttgcaagtcacccatctcaggaaaaaggaggttggcaactaaagacatgaggcagggatgctagattaatgtcaggaccatttctcttctgccccacgcagcccctagaaagtagtaagctgtgaggcttttctggctccccagggcttacgtgggaagagccaggcatggcatagaggttgtggcccttctttttttc

SEQ ID NO: 192850 - DNA, 2025 bp, Homo sapiens
  Payload ID: 18065
  Gene Name: transient receptor potential cation channel, subfamily V, member 5
  ENST ID: ENST00000439304
  CDS Start-End: 1-2025
aaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccatagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctatgatggacatggggaccacctgcagcccctggaccttgtgcccaatcaccagggtctcacccccttcaagctggctggagtggagggtaacactgtggctcgccaaattctggaacagaccccagtgaaggagctggtgagcttcaagtggaacaagtatggccggccgtacttctgcatcctggctgccttgtacctgctctacatgatctgctttactacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatcatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccgcgttctatatcattttccagacagaggacccaaccagtctggggcaattctatgactaccccatggcactgttcaccacctttgagctttttctcactgttattgatgcacctgccaactacgacgtggacttgcccttcatgttcagcattgtcaacttcgccttcaccatcattgccacactgctcatgctcaacttgttcatcgccatgatgggcgacacccactggagggtggcccaggagagggatgagctctggagggcccaggtcgtggccaccacagtgatgctggagcggaagctgcctcgctgcctgtggcctcgctccgggatctgtgggtgcgaattcgggctgggggaccgctggttcctgcgggttgagaaccacaatgatcagaatcctctgcgagtgcttcgctatgtggaagtgttcaagaactcagacaaggaggatgaccaggagcatccatctgagaaacagccctctggggctgagagtgggactctagccagagcctctttggctcttccaacttcctccctgtcccggaccgcgtcccagagcagcagtcaccgaggctgggagatccttcgtcaaaacaccctggggcacttgaatcttggactgaaccttagtgagggggatggagaggaggtctaccatttttga

SEQ ID NO: 192851 - DNA, 2120 bp, Homo sapiens
  Payload ID: 18065
  Gene Name: transient receptor potential cation channel, subfamily V, member 5
  Uniprot ID: Q9NQA5
  ENST ID: ENST00000442623
  CDS Start-End: 265-1410
cacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccatagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctatgatggacatggggaccacctgcagcccctggaccttgtgcccaatcaccagggtctcacccccttcaagctggctggagtggagggtaacactgtgatgttccagcacctgatgcagaagcggaggcacatccagtggacgtatggacccctgacctccattctctacgacctcacggagatcgactcctggggagaggagctgtccttcctggagcttgtggtctcctctgataaacgagaggctcgccaaattctggaacagaccccagtgaaggagctggtgagcttcaagtggaacaagtatggccggccgtacttctgcatcctggctgccttgtacctgctctacatgatctgctttactacgtgctgcgtctaccgcccccttaagtttcgtggtggcaaccgcactcattctcgagacatcaccatcctccagcaaaaactactacaggtgattctcctcagaaggggatgagagagaattgcatcaaggggtgatggtgctggaaacgaagccatgctactcagggacgatgccacgctctgggttccagcaggtgtaggctcctaaacacccaggtagaaattagacatgagaccaggaggccacagatggggtttaatgagcacaagagcatttgtccagggagctgtggattttctcacacaaactttgaaagagtgcttggcatgagtaagcctgtgcttttgtgaaattttttggtaatttacaaaaagtatcagggttttttagtgggatgttcaaggtaaactctattgctcaaaaggaggaaaattgtgctccaagtccatttctgagtccatttttgttgtatttgggcaacacagacagccctgctggcctgcaccctcttctgtgtgctgtctatatgggcccatgggaataatgtgtcagctgtctgactgcctgtcagacactctgcagaaggatgtctggattgggtatcaggctgaagtaaatactctctgaggctccatttagtgttgtgggcctgccattctgtgttgtggtggccaagggaaaactagggttaggaagaggactgattcgaggtacacagtaaatatagaaatctgctgttgaagaaagtaaacctcctttttgtgcaacagaaagggtagactctaatgagcacttctgaatatatatatttaacaactgta

SEQ ID NO: 192852 - DNA, 2952 bp, Homo sapiens; identical to SEQ ID NO: 192849
  Payload ID: 18065
  Gene Name: transient receptor potential cation channel, subfamily V, member 5
  ENST ID: ENST00000621710
  CDS Start-End: 350-2539

SEQ ID NO: 192853 - DNA, 2025 bp, Homo sapiens; identical to SEQ ID NO: 192850
  Payload ID: 18065
  Gene Name: transient receptor potential cation channel, subfamily V, member 5
  ENST ID: ENST00000633909
  CDS Start-End: 1-2025

SEQ ID NO: 192854 - DNA, 2120 bp, Homo sapiens; identical to SEQ ID NO: 192851
  Payload ID: 18065
  Gene Name: transient receptor potential cation channel, subfamily V, member 5
  ENST ID: ENST00000633067
  CDS Start-End: 265-1410

SEQ ID NO: 192855 - DNA, 2928 bp, Homo sapiens
  Payload ID: 18066
  Gene Name: transient receptor potential cation channel, subfamily V, member 6
  Uniprot ID: Q9H1D0
  ENST ID: ENST00000359396
  CDS Start-End: 127-2424
agacaggccagccctgcagagtcctggctggctctgccaagtgtaacaaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacagtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctgccca

SEQ ID NO: 192856 - DNA, 532 bp, Homo sapiens
  Payload ID: 18066
  Gene Name: transient receptor potential cation channel, subfamily V, member 6
  ENST ID: ENST00000436401
  CDS Start-End: 167-532
agagtcctggctggctctgccaagtgtaacaaactcacagccctctccaaactggctggggctgctgggagactcccaaggaactcgtcaggaaggcaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtg

SEQ ID NO: 192857 - DNA, 247 bp, Homo sapiens
  Payload ID: 18066
  Gene Name: transient receptor potential cation channel, subfamily V, member 6
  ENST ID: ENST00000431833
  CDS Start-End: 78-247
aggccctgaacaagttgctcaagtatgaggattgcaaggtgcaccagagagaagccatataacccacctctctgtaaatgccaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacat

SEQ ID NO: 192858 - DNA, 3071 bp, Homo sapiens
  Payload ID: 18066
  Gene Name: transient receptor potential cation channel, subfamily V, member 6
  ENST ID: ENST00000463646
  CDS Start-End: 790-2370
ataggatctgggagtctcctctccttctagctgccaaagataatgatgtccaggccctgaacaagttgctcaagtatgaggattgcaaggtgcaccagagaggtaagaagcacaaatgcagcatgatctcctaggtgagccccacacatggggcctcccaggagtgcccaggacctcgtgctgttggcctctgaatctatcgtctccaatccgctgtcccacagaagccatataacccacctctctgtaaatgccaggagccatgggggaaacagcgctacacatagcagccctctatgacaacctggaggccgccatggtgctgatggaggctgccccggagctggtctttgagcccatgacatctgagctctatgagggtgagggcccacgggtctggggtgaagagcaggagtgactggttgggtatttcaagtcagtctctgtgatggataatttgggaaagacacaggggatctgagcctcctactctttttttctcttctctgtctcccttccgtgtcagtcctgactgcccatcactagaacgcctgccccctgaaatgccaggggcctagagaagaggaagagatgggcagcagctggatcccctgggaatcctgaacacccgagagctccctgttctccatcccaggctacccctgagggaaagagactggggtgcatatgggagggaccccctgcaggatcctggggacagacccgtgactgacagctgtctctgggccaggtcagactgcactgcacatcgctgttgtgaaccagaacatgaacctggtgcgagccctgcttgcccgcagggccagtgtctctgccagagccacaggcactgccttccgccgtagtccctgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacgagcccccgggacaacaccctcttacagcagaagctacttcaggaagcctacatgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccagattgtggccaccacagtgatgctggagcggaagctgcctcgctgcctgtggcctcgctccgggatctgcggacgggagtatggcctgggagaccgctggttcctgcgggtggaagacaggcaagatctcaaccggcagcggatccaacgctacgcacaggccttccacccggggctctgaggatttggacaaagactcagtggaaaaactagagctgggctgtcccttcagcccccacctgtcccttcctatgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccaggccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcgg

SEQ ID NO: 192859 - DNA, 2927 bp, Homo sapiens
  Payload ID: 18066
  Gene Name: transient receptor potential cation channel, subfamily V, member 6
  ENST ID: ENST00000611485
  CDS Start-End: 247-2424
agacaggccagctctgcagagtcctggctggctctgccaagtgtaacaaactcacagccctctccaaactggctggggctgctgggagactcccaaggaactcgtcaggaaggcaggagacaggagacgggacctctacagggagacggtgggccggcccttgggggggctgatgtggccccaaggctgagtcccgtcagggtctggcctcggcctcaggcccccaaggagccggccctacaccccatgggtttgtcactgcccaaggagaaagggctaattctctgcctatggagcaagttctgcagatggttccagagacgggagtcctgggcccagagccgagatgagcagaacctgctgcagcagaagaggatctgggagtctcctctccttctagctgccaaagataatgatgtccaggccctgaacaagttgctcaagtatgaggattgcaaggtgcaccagagaggagccatgggggaaacagcgctacacatagcagccctctatgacaacctggaggccgccatggtgctgatggaggctgccccggagctggtctttgagcccatgacatctgagctctatgagggtcagactgcactgcacatcgctgttgtgaaccagaacatgaacctggtgcgagccctgcttgcccgcagggccagtgtctctgccagagccacaggcactgccttccgccgtagtccccgcaacctcatctactttggggagcaccctttgtcctttgctgcctgtgtgaacagtgaggagatcgtgcggctgctcattgagcatggagctgacatccgggcccaggactccctgggaaacacagtgttacacatcctcatcctccagcccaacaaaacctttgcctgccagatgtacaacctgttgctgtcctacgacagacatggggaccacctgcagcccctggacctcgtgcccaatcaccagggtctcacccctttcaagctggctggagtggagggtaacactgtgatgtttcagcacctgatgcagaagcggaagcacacccagtggacgtatggaccactgacctcgactctctatgacctcacagagatcgactcctcaggggatgagcagtccctgctggaacttatcatcaccaccaagaagcgggaggctcgccagatcctggaccagacgccggtgaaggagctggtgagcctcaagtggaagcggtacgggcggccgtacttctgcatgctgggtgccatatatctgctgtacatcatctgcttcaccatgtgctgcatctaccgccccctcaagcccaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtggtcatcctgggctttgcttcagccttctatatcatcttccagacagaggaccccgaggagctaggccacttctacgactaccccatggccctgttcagcaccttcgagctgttccttaccatcatcgatggcccagccaactacaacgtggacctgcccttcatgtacagcatcacctatgctgcctttgccatcatcgccacactgctcatgctcaacctcctcattgccatgatgggcgacactcactggcgagtggcccatgagcgggatgagctgtggagggcccaggttgtggccaccacggtgatgctggagcggaagctgcctcgctgcctgtggcctcgctccgggatctgcggacgggagtatggcctgggggaccgctggttcctgcgggtggaagacaggcaagatctcaaccggcagcggatccaacgctacgcacaggccttccacacccggggctctgaggatttggacaaagactcagtggaaaaactagagctgggctgtcccttcagcccccacctgtcccttcctacgccctcagtgtctcgaagtacctcccgcagcagtgccaattgggaaaggcttcggcaagggaccctgaggagagacctgcgtgggataatcaacaggggtctggaggacggggagagctgggaatatcagatctgactgcgtgttctcacttcgcttcctggaacttgctctcattttcctgggtgcatcaaacaaaacaaaaaccaaacacccagaggtctcatctcccagccccaggggagaaagaggagtagcatgaacgccaaggaatgtacgttgagaatcactgctccaggcctgcattactccttcagctctggggcagaggaagcccagcccaagcacggggctggcagggcgtgaggaactctcctgtggcctgctcatcacccttccgacaggagcactgcatgtcagagcactttaaaaacaggccagcctgcttgggcgctcggtctccaccccagggtcataagtggggagagagcccttcccagggcacccaggcaggtgcagggaagtgcagagcttgtggaaagcgtgtgagtgagggagacaggaacggctctgggggtgggaagtggggctaggtcttgccaactccatcttcaataaagtcgttttcggatccctgccca

SEQ ID NO: 192860 - DNA, 247 bp, Homo sapiens; identical to SEQ ID NO: 192857
  Payload ID: 18066
  Gene Name: transient receptor potential cation channel, subfamily V, member 6
  ENST ID: ENST00000633826
  CDS Start-End: 1-62

SEQ ID NO: 192861 - DNA, 532 bp, Homo sapiens
  Payload ID: 18066
  Gene Name: transient receptor potential cation channel, subfamily V, member 6
  ENST ID: ENST00000633318
  CDS Start-End: 263-532
agagtcctggctggctctgccaagtgtaacaaactcacagccctctccaaactggctggggctgctgggagactcccaaggaactcgtcaggaaggcaggaccaataaccgcacaagcccccgggacaacaccctcttacagcagaagctacttcaggaagcctacgtgacccctaaggacgatatccggctggtcggggagctggtgactgtcattggggctatcatcatcctgctggtagaggttccagacatcttcagaatgggggtcactcgcttctttggacagaccatccttgggggcccattccatgtcctcatcatcacctatgccttcatggtgctggtgaccatggtgatgcggctcatcagtgccagcggggaggtggtacccatgtcctttgcactcgtgctgggctggtgcaacgtcatgtacttcgcccgaggattccagatgctaggccccttcaccatcatgattcagaagatgatttttggcgacctgatgcgattctgctggctgatggctgtg

SEQ ID NO: 192862 - DNA, 407 bp, Homo sapiens
  Payload ID: 18067
  Gene Name: transition protein 1 (during histone to protamine replacement)
  Uniprot ID: P09430
  ENST ID: ENST00000236979
  CDS Start-End: 31-198
gcaaagcccctcattttggcagaacttaccatgtcgaccagccgcaaattaaagagtcatggcatgaggaggagcaagagccgatctcctcacaagggagtcaagagaggtggcagcaaaagaaaataccgtaagggcaacctgaaaagtaggaaacggggcgatgacgccaatcgcaattaccgctcccacttgtgagcccccagcgggctctgccctggtgcgcttcacacagcaccaagcagcaacaagaacagcagaaggggaactgccaaggagacctgatgttagatcaaagccagagaggagcctatggaatgtggatcaaatgccagttgtgacgaaatgaggaatgtatatgttggctgtttttccccaacatctcaataaaactttgaaagcagaaa

SEQ ID NO: 192863 - DNA, 626 bp, Homo sapiens
  Payload ID: 18068
  Gene Name: transition protein 2 (during histone to protamine replacement)
  Uniprot ID: Q05952
  ENST ID: ENST00000312693
  CDS Start-End: 71-487
ggcctctgtaaagctaggcctgctgggagaggatgaggaggaggccctgcccctccaaacgtggcctcctatggacacccagactcacagccttcctatcacccacactcagctccatagcaactctcagccccaaagccgcacctgcacccgccattgccaaaccttcagccagagttgcagacagagccatcgtggcagccggagccagagctccagccagagcccggccagccaccgcaacccaactggagcccacagctcatccggccaccagagccagagtcccaacactagtccaccaccaaagcgccacaaaaagactatgaactcccaccactctcccatgcggcccaccatcctgcactgccgctgccccaagaacagaaagaacttggaaggcaagctgaaaaagaaaaaaatggccaagaggatccagcaggtgtacaaaaccaagacgcggagctcaggatggaaatccaactaatgagaccgcactccttggcttgttcctgcgtgtttcacccaaaggagaaaatgctaggatgaagtcaatcttcttgcaggaacatgttactatggtgatttctacgcaacactaattaaagcttgtacctggaagacta

SEQ ID NO: 192864 - DNA, 1931 bp, Homo sapiens
  Payload ID: 18069
  Gene Name: transketolase
  ENST ID: ENST00000296289
  CDS Start-End: 461-1834
cgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttgtgggatggcctacaccggcaaatacttcgacaaggccagctaccgagtctattgcttgctgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttg

SEQ ID NO: 192865 - DNA, 2075 bp, Homo sapiens
  Payload ID: 18069
  Gene Name: transketolase
  Uniprot ID: P29401
  ENST ID: ENST00000423516
  CDS Start-End: 81-1976
ctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagcctcccgagtagctgggactacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgag

SEQ ID NO: 192866 - DNA, 2831 bp, Homo sapiens
  Payload ID: 18069
  Gene Name: transketolase
  Uniprot ID: P29401
  ENST ID: ENST00000423525
  CDS Start-End: 59-1930
gggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcggccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagcc

SEQ ID NO: 192867 - DNA, 1941 bp, Homo sapiens
  Payload ID: 18069
  Gene Name: transketolase
  ENST ID: ENST00000450814
  CDS Start-End: 81-542
ctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgag

SEQ ID NO: 192868 - DNA, 1055 bp, Homo sapiens
  Payload ID: 18069
  Gene Name: transketolase
  ENST ID: ENST00000472528
  CDS Start-End: 46-291
atctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctgggtgtagtgtcttttcccatgaccgggagttcatagaaataccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagatggagtctcgctctgtcacccaggctggagtgcagtggtacgatctcggcccactgcaacctccgcctcccgggttcaagtgattctcctcctgcctcagcctcccgagtagctgggactacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaa

SEQ ID NO: 192869 - DNA, 3010 bp, Homo sapiens
  Payload ID: 18069
  Gene Name: transketolase
  Uniprot ID: P29401
  ENST ID: ENST00000462138
  CDS Start-End: 90-1961
gcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaaggtggtcctgaagagcaaggatgaccaggtgaccgttatcggggctggggtgaccctgcacgaggccttggccgctgccgaactgctgaagaaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaattggccctgaaatgttttcttttttgatgtgtttgcagccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagccaaggtca

SEQ ID NO: 192870 - DNA, 1871 bp, Homo sapiens
  Payload ID: 18069
  Gene Name: transketolase
  ENST ID: ENST00000469678
  CDS Start-End: 33-1037
cgcgtgtgcgcccggtccccgcctgccgcaccatggagagctaccacaagcctgaccagcagaagctgcaggccttgaaggacacggccaaccgcctacgtatcagctccatccaggccaccactgcggcgggctctggccaccccacgtcatgctgcagcgccgcagagatcatggctgtcctctttttccacaccatgcgctacaagtcccaggacccccggaatccgcacaatgaccgctttgtgctctccaagggccatgcagctcccatcctctacgcggtctgggctgaagctggtttcctggccgaggcggagctgctgaacctgaggaagatcagctccgacttggacgggcacccggtcccgaaacaagctttcaccgacgtggccactggctccctgggccagggcctcggggccgcttgtgggatggcctacaccggcaaatacttcgacaaggccagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcggttggcatgccatcatcgtggatggacacagcgtggaggagctgtgcaaggcctttggccaggccaagcaccagccaacagccatcattgccaagaccttcaagggccgagggatcacgggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaaggtacaaaatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggggaagacgggccctcccagatggccctagaagatctggctatgtttcggtcagtccccacatcaactgtcttttacccaagtgatggcgttgctacagagaaggcagtggaactagccgccaatacaaagggtatctgcttcatccggaccagccgcccagaaaatgccatcatctataacaacaatgaggacttccaggtcggacaagccaagaaaagatcaacatccgcgtgctggaccccttcaccatcaagcccctggacagaaaactcattctcgacagcgctcgtgccaccaagggcaggatcctcaccgtggaggaccattattatgaaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaag

SEQ ID NO: 192871 - DNA, 2566 bp, Homo sapiens
  Payload ID: 18070
  Gene Name: transketolase-like 1
  Uniprot ID: P51854
  ENST ID: ENST00000369912
  CDS Start-End: 282-1904
aaacttgccccgagtccacggtgctctgcggttaggagctggcctcactgtgcacagggggaggggtggtgagcttaccgggctttaaagcgcccttccaacctgtgagccctgcattccttacccttggttggattcttcccgggctgggagaaatgaccgcttctatgaggagaccatgtgccgaggtcgtgtgctaggaagccagttgctgtgagaaatgaccagtgtcatgtctgtctttcagccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 192872 - DNA, 2642 bp, Homo sapiens
  Payload ID: 18070
  Gene Name: transketolase-like 1
  Uniprot ID: P51854
  ENST ID: ENST00000369915
  CDS Start-End: 190-1980
agatcccttgacttgcttgcggagggagcggccggcggagggagcggcaggtggagggagtggcacgaggcatgcggagggagctgcaccgacatcacataaacgcactgggcagctcgcaggcgccattcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccattatcaaattaattgagagccagatacagaccagcaggaatcttgacccacagccccccattgaggactcacctgaagtcaacatcacagatgtaaggatgacctctccacctgattacagagttggtgacaagatagctactcggaaagcatgcggtctggctctggctaagctgggctacgcgaacaacagagtcgttgtgctggatggtgacaccaggtactctactttctctgagatattcaacaaggagtaccctgagcgcttcatcgagtgctttatggctgaacaaaacatggtgagcgtggctctgggctgtgcctcccgtggacggaccattgcttttgctagcacctttgctgcctttctgactcgagcatttgatcacatccggataggaggcctcgctgagagcaacatcaacattattggttcccactgtggggtatctgttggtgacgatggtgcttcccagatggccctggaggatatagccatgttccgaaccattcccaagtgcacgatcttctacccaactgatgccgtctccacggagcatgctgttgctctggcagccaatgccaaggggatgtgcttcattcggaccacccgaccagaaactatggttatttacaccccacaagaacgctttgagatcggacaggccaaggtcctccgccactgtgtcagtgacaaggtcacagttattggagctggaattactgtgtatgaagccttagcagctgctgatgagctttcgaaacaagatatttttatccgtgtcatcgacctgtttaccattaaacctctggatgtcgccaccatcgtctccagtgcaaaagccacagagggccggatcattacagtggaggatcactacccgcaaggtggcatcggggaagctgtctgcgcagccgtctccatggatcctgacattcaggttcattcgctggcagtgtcgggagtgccccagagtgggaagtccgaggaattgctggatatgtatggaattagtgccagacatatcatagtggccgtgaaatgcatgttgctgaactaaaatagctgttagctttggtcttttggcctctttaccctgtgtttatgtttgttccaaaaccatcatttaaatctctactgtcacattttgtttcttaaaagcaaagccagctaacaccttcattcatccctagttcggaaattcaagctaactacttaccctttaaactgtcactgcatatgcaagtaccgctctaatttttggatcattaaagggagttacacaacttttaagtgaaaaaaataggtaacaaaacaaccacctgatagtaagttttctgataagactatagataagtggtagaggtaatcaattcttccgaagtgtttccttcgtgaataactggtagaggtaatagttttttcaatgtatttccttcatgagtaaagaaaatgtggattgaagtatagattccagtagcctagtttccacagcacgataacaccatgacgcctactgctgttcccaccttgggattctgtgtgctgccatcccacctgcagctgccctggaattcccttcgctgtttgccttcatctccctccacgtttgagaggctgtcaggcagcagcgaaagcttgttaggatgtcctgtgctgcttgtgatgagagcctccacactgtactgttcaagtcaatgttaataaagcatttcaaaacca

SEQ ID NO: 192873 - DNA, 560 bp, Homo sapiens
  Payload ID: 18070
  Gene Name: transketolase-like 1
  ENST ID: ENST00000439635
  CDS Start-End: 62-445
ttcgctcttcagacgccggagacgtaggagtgggtcttcagactccaaaggggttggactaatggcggatgctgaggcgagggctgagttcccggaggaggccagacctgacaggggcaccttgcaggtgttgcaagatatggccagccgcttgcgaatccattccatcagggccacatgctccacgagctccggccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaacacttatgtggtggacggccgggacgtggaggcactgtgccaggtattctggcaggcttctcaggtgaagcacaagcccactgctgtggtggccaagaccttcaagggccggggcaccccaagtattgaggatgcagaaagttggcatgcaaagccaatgccgagagaaagagcagatgccat

SEQ ID NO: 192874 - DNA, 622 bp, Homo sapiens
  Payload ID: 18070
  Gene Name: transketolase-like 1
  ENST ID: ENST00000426989
  CDS Start-End: 31-622
attcattgtagaaggtagaatgggatcttcatggcatttctgattcacaatgctcctgaaagttcctcggcatgtggaaaggccacagatgaatttaagcatgtgaaagaatactcatgtcagaggcacaaaggaaacttgccccgagtccacggtgctctgcgccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtggaggcactgtgccagg

SEQ ID NO: 192875 - DNA, 525 bp, Homo sapiens
  Payload ID: 18070
  Gene Name: transketolase-like 1
  ENST ID: ENST00000426203
  CDS Start-End: 1-525
agaggcacaaaggaaacttgccccgagtccacggtgctctgcggttaggagctggcctcactgtgcacagggggaggggtgccaccctacatcatgtagcagttcttctgagatcatgtctgtgctgttcttctacatcatgaggtacaagcagtcagatccagagaatccggacaacgaccgatttgtcctcgcaaagagactgtcgtttgtggatgtggcaacaggatggctcggacaaggactgggagttgcatgtggaatggcatatactggcaagtacttcgacagggccagctaccgggtgttctgcctcatgagtgatggcgagtcctcagaaggctctgtctgggaggcaatggcctttgcttcctactacagtctggacaatcttgtggcaatctttgatgtgaaccgcctgggacacagtggtgcattgcccgccgagcactgcataaacatctatcagaggcgctgcgaagcctttgggtggaacacttatgtggtggacggccgggacgtgga

SEQ ID NO: 192876 - DNA, 2654 bp, Homo sapiens
  Payload ID: 18071
  Gene Name: transketolase-like 2
  Uniprot ID: Q9H0I9
  ENST ID: ENST00000280605
  CDS Start-End: 13-1893
gacaaaagagagatgatggccaacgacgccaagcccgacgtgaagaccgtgcaggtgctgcgggacacagccaaccgcctgcggatccattccatcagggccacgtgtgcctctggttctggccagctcacgtcgtgctgcagtgcagcggaggtcgtgtctgtcctcttcttccacacgatgaagtataaacagacagacccagaacacccggacaacgaccggttcatcctctccaggggacatgctgctcctatcctctatgctgcttgggtggaggtgggtgacatcagtgaatctgacttgctgaacctgaggaaacttcacagcgacttggagagacaccctaccccccgattgccgtttgttgacgtggcaacagggtccctaggtcagggattaggtactgcatgtggaatggcttatactggcaagtaccttgacaaggccagctaccgggtgttctgccttatgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatctgactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttctgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcatttaaaaatcagata

SEQ ID NO: 192877 - DNA, 1978 bp, Homo sapiens
  Payload ID: 18072
  Gene Name: translation machinery associated 16 homolog
  Uniprot ID: Q96EY4
  ENST ID: ENST00000358572
  CDS Start-End: 342-953
tctccacccgggctccaatccccagcctcgcactcagcaccaggcagagttcagcctcccgccgcaagctcccttccgccgctcccggcgagcacgcaggtctggctgtccgttgggctagagcttaaaagcccaacacgggcgaaaaagacgcggtctcagttaacggggacgctttagagaaacgcactcgcctctcctgttccggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactattataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacattaaacctattttccttttttacagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttattttttttttaaaagagcacaatgtaggtgtatttgagtattttcaagaaaagaataaaaacattaatgcagtattaggttaactggatatcaactaagccttgttaacagttaaagtattataactttttttacttctgaaaattaaaaataaaatttatttctgcaatttca

SEQ ID NO: 192878 - DNA, 608 bp, Homo sapiens
  Payload ID: 18072
  Gene Name: translation machinery associated 16 homolog
  ENST ID: ENST00000508268
  CDS Start-End: 95-529
ggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttaggtgagtctgtcttgtattgttcccctgaagctgtgtgtaaagtacctgacaggtgaactttcttcccctttgagtctagccgg

SEQ ID NO: 192879 - DNA, 747 bp, Homo sapiens
  Payload ID: 18072
  Gene Name: translation machinery associated 16 homolog
  ENST ID: ENST00000513134
  CDS Start-End: 115-420
tcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaagaataagggaaaatgtgataagaagtttgtatacatttctggattatagattattatttatcttttgaaccagagctaaatggtaaaagaaaaaaaatcagtgatgattgttatgttgatctcccacaattaatttatcttttgacaaaggggataaagagtttcagtttagctccttttgattgtatattattttttgcttttttattgtgaaaagaggtaggttttatttgtggagagagagttgaagattagggaaccagtgattttaattatgctactttttcttctaagagataaattgatatatcattcagtgtcatgaaaaacatgaatgttgtacaattttcttcctcaaaaaactttttaaatgtaagtatccttatttttttttt

SEQ ID NO: 192880 - DNA, 933 bp, Homo sapiens
  Payload ID: 18072
  Gene Name: translation machinery associated 16 homolog
  ENST ID: ENST00000509657
  CDS Start-End: 1-727
gggccggaagcgtgtagcgtctccacccgggctccaatccccagcctcgcactcagcaccaggcagagttcagcctcccgccgcaagctcccttccgccgctcccggcgagcacgcagcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaaggtacttaaatcgattcagcagtgagctggagcagattgagttacataacagtatcagggacaggcaggggaggcggcactgttcccgggagaccgtcatcaagcagacgatggagcgggagcgacagcagtttgagggatatggccttgagattccagacattctaaatgcaagtaatctgaaaacatttagggaatgggactttgatctgaagaaattaccaaacattaaaatgagaaaaatttgcgctaatgatgcaattcccaagacgtgcaagaggaaaactattataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagata

SEQ ID NO: 192881 - DNA, 803 bp, Homo sapiens
  Payload ID: 18072
  Gene Name: translation machinery associated 16 homolog
  ENST ID: ENST00000513272
  CDS Start-End: 136-402
ggttgggtcggcgcgggcttctcaggcgccacgtgggattcggcccgggtgctcttgtgagctgctgctcctgcggttggtgagattacctgggtctagagtgcggagctgctccgtggccacgaggacgtcaccatgcccaaagcaccaaagggaaaaagtgcaggacgggaaaaaaaagtcatccatccatatagtagaaaagcagctcaaattacgagagaggcccacaaacaagaaaaaaaggaaaaattgaagaatgaaaaggccttgcgtctcaaccttgttggtgaaaaactgcaatggtttcaaaatcatcttgatccccaaaaaaagagatattcaaagaaagatgcttgtgaactaattgaaagagattccagacattctaaatgcaagtaatctgaaaacatttagggaatgggactttgatctgaagaaattaccaaacattaaaatgagaaaaatttgcgctaatgatgcaattcccaagacgtgcaagaggaaaactattataactgtagaccaagatttgggggaattggaactaaacgatgaatcaagtgattcagatgaggaaatgactgcagtggcctaattgtcttcacttgaattgaaaataaataatttgagagcttcaaattatattcattgattatggtacctaattgtcatgatacaaaaatttgatactgacattctcttatatgatgagagtttcatttgcgtttcaaaaatggtgttatgatacttattttaaaatgaagattgcttttcatttccattaagttgctaaaatagat

SEQ ID NO: 192882 - DNA, 561 bp, Homo sapiens
  Payload ID: 18073
  Gene Name: translation machinery associated 7 homolog
  Uniprot ID: Q9Y2S6
  ENST ID: ENST00000438607
  CDS Start-End: 41-235
gtttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcgttcctaccataactgtgaatttaaagtaaaaccagctcagaatcttgccagagtctgttctttggtccttgttctaccctaaactttgtatcacctgaaattaaaccaactcatttgaaagga

SEQ ID NO: 192883 - DNA, 1469 bp, Homo sapiens
  Payload ID: 18074
  Gene Name: translational activator of mitochondrially encoded cytochrome c oxidase I
  Uniprot ID: Q9BSH4
  ENST ID: ENST00000258975
  CDS Start-End: 213-1106
gtgctacgccatcaagggcccccagtcccgggtgccgcggggacagtgtagggtcattagctgttgagccgccccgggcgggcccaagcctttggatctcaggtgaccggcacaggcggccgcggggtccggaactgcttgttccggcagtggaagagacgcgccggcgttggccgctgctgctagcagcttgaaccccagggtcgggaccgatgtcggcttgggctgctgccagcctaagcagggccgctgcccgatgcttgctggcacgaggccccggggtcagggcggctcctccgcgcgacccccggccctcccaccccgagccccggggctgcggtgccgctccgggcaggacgctgcactttaccgcggctgtccccgccgggcacaacaagtggtccaaagtcaggcacatcaagggtccgaaggacgtcgaaaggagtcgcatcttctccaaactctgtttgaacatccgcctggcagtgaaagaaggaggccccaaccctgagcacaacagcaacctggccaatatcttagaggtgtgtcgcagcaaacatatgcccaagtcaacgattgagacagcactgaaaatggagaaatccaaggacacttatttgctgtatgagggtcgaggccctggtggctcttctctgctcatcgaggcattatctaacagtagccacaagtgccaagcagacattagacatatcctgaataagaatggaggagtgatggctgtaggagctcgtcactcttttgacaaaaagggggtgattgtggttgaagtggaggacagagagaagaaggctgtgaacctagagcgtgccctggagatggcaatcgaagcaggagctgaggatgtcaaggaaactgaagatgaagaagaaaggaacgtttttaaatttatttgtgatgcctcttcactgcaccaagtgaggaagaagctggactccctgggcctgtgttctgtgtcctgtgcactagagttcatccccaactcaaaggtgcagctggctgagcccgacctggaacaggccgcacatctcattcaggctctcagcaaccacgaggatgtgattcacgtctatgataacattgaataaccaggctacatgtgcccccgggttccttcctagaaatgtggcagcccattccagcacacaggcttctgcagcaatctctgagggtaaagccggtgggaggctcagcaggccaggaggcccaaggacaggacttgcgaccttgaagccaaaggaatctcacttgtggggcctccttgtcagctctgctgctgtctcagagccatctggatgagtgtcccgacaccctctcggatgcagggcaggaccacccagctggtcagactctgatgttgggtagctggcctctgtggggattgtaagtgccctgaggcgctctgtactagaaactgctcttaataataacggtgattattggttgctgca

SEQ ID NO: 192884 - DNA, 3420 bp, Homo sapiens
  Payload ID: 18075
  Gene Name: translin
  Uniprot ID: Q15631
  ENST ID: ENST00000389682
  CDS Start-End: 248-934
cctctcctctgccctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcatagtttcataattgtgtactcggaaattaaagtttgcttgtttcttggtctggattaaa

SEQ ID NO: 192885 - DNA, 1436 bp, Homo sapiens
  Payload ID: 18075
  Gene Name: translin
  ENST ID: ENST00000409193
  CDS Start-End: 471-1142
ttaaaagcacatgtgatctgcttaaaactctcctgtgatttcctatgccacacaggataaaaaatcagactctactgtggctcacatggtttctcttcaatctcgtttatgctctctgtctttgtgtatgatgttcactttacctcttctagtgccccaaatagcttcctgcctgtttgcttttcctggaatttgcttctttcccgttcttttcctgattgtctcgtatttatctcattggcgtcacagtctaagcgatctatttcctgttatgttttctagtagcacattaactttttttaatgtgtgtaatattgattattttaaaaaaatcttctccctcattgtatgttaaaccgccagagggaagggattgtgtgcttggttccccggtatttacacagtgcctcgcacataagtatgctcagtgaatattttaaaaatgaattagaggcggggagcggcgcctcatgcctgtaattccagcattttgggaggccgaggcggccagatcacctgaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgctta

SEQ ID NO: 192886 - DNA, 555 bp, Homo sapiens
  Payload ID: 18075
  Gene Name: translin
  ENST ID: ENST00000455432
  CDS Start-End: 1-555
acgaggtcgtgccgagagactgggagaggcgtgagtcgcgcggaggcgcgacatggggcgtgacgaggagcggagggcggggcgaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccg

SEQ ID NO: 192887 - DNA, 3328 bp, Homo sapiens
  Payload ID: 18075
  Gene Name: translin
  Uniprot ID: Q15631
  ENST ID: ENST00000536142
  CDS Start-End: 236-682
cctttggacgcgcgcctcggttccgaacgcagcggacggcgcctcaggcagcgcggcggacagcccgtcctccggcgcgccgcgagcctcggaggaccctagcgacggtcgtggcgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcatcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaagtgagtgtgctgctgtaagaaatctcccatgtgcataacaaattctgaatattttttgaggctaaagaagaccggggtgacaagcagatactgctgtgtaatggttacactaaccaaaagacaccagccactcagagttctatactgtaaagcgcagataacatttgtgtgttataccttgattggggaattaaaagtcatttaactgaagatgttgagaaacctgggctctggttttagtataccggaattacttttttccaattttagaaaatcaagcaggttagagaaaatagagatgaattaggggacactgtcttatggattcatttataagaagagaaccagccatatacacttggggagatttgccacatcttaaacttgaataatagtatgagtaatgcttaagggagtttaatagagaaggaaagctttggcagtgttttgagaacttaagtggctaaagagatgagacaaacatgcaggtcgctactggcatagtttcataattgtgtactcggaaattaaagtttgcttgtttcttggtctggattaaa

SEQ ID NO: 192888 - DNA, 2717 bp, Homo sapiens
  Payload ID: 18075
  Gene Name: translin
  ENST ID: ENST00000490104
  CDS Start-End: 118-396
agaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggaaatcagaaaagttgtacagagtttagaacaaacagctcgagagattttaactctactgcaaggggtccatcagggtgctgggtttcaggacagtaagttctttgttttgtatccaattatcagtctcttatttagagggagagtttctatccagaagacattttataatgaaaaatggctatcatgctttatgttccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcac

SEQ ID NO: 192889 - DNA, 2843 bp, Homo sapiens
  Payload ID: 18075
  Gene Name: translin
  ENST ID: ENST00000467324
  CDS Start-End: 122-232
cgtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggcgagccccctcccttccccattccctttgcctttccatgcctagttgggccacttcgcccggccctcctctgtcgctcagtctcgggcggtggggacgcctccgagggaaatcagaaaagttgtacagagtttagaacaaacagctcgagagattttaactctactgcaaggggtccatcagggtgctgggtttcaggacattccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggttttcgccttctcaacctgaaaaatgactccctgaggaagcgctacgacggattgaaatatgacgtgaagaaagtagaggaagtggtctatgatctctccatccggggctttaataaggagacggcagcagcttgtgttgaaaaataggaggctctccttgctcctggccttgctgacctcagcggttgccaggaaggggtgagcacagagtgcctcttacggtagttaggatgctcagttgctaaacactgcgctttattttcttaaccagttgtggtgtgagtatcagaattgaaacacttttttgggggtaaaaaatatagcctttacatggacagaattttttttgttgtttcagtgaatatgcctgtaattcagtgtatttcagttccgtcagaaagtgtaaatgttagtttcttggtaaagtccttttcttgcttaccttgactgttgatgtactgattgagaagttcattgtctcgtttgtgattcttccagatgtgatgcttgatattttctatatgcgagttagccatccacacccaggcatagcctggatacagtataaaaatagataattaaaaagatggttgccaagcaaggaaaacttattttatattttcccttccttattttaagcattgtgagtaaatcagatgttgaattcttttgccaagggaattatagctgcaggttctctctcactgccatcaaactgtaaaagattaaactgcgaagtcaagctcaacagattattttggaaagtttttgtattaagggatttagtaacatcattttgttttccaccaggcagggagtagggcttagtgttttaaaacacctctgctttctgatgttgccttaatattctgctattgcagcaattaaaaattgtcttcatgtacatttggaactaacacgtgatgtgatatattcctaaactatgaaacctttttcctagtagtcagctagatcatttgttctgggagtataaagccacccacgtaagttaataagcaaaatcctgactattatgttgttagagaaaaatgctttgctttgtctggaagaaagataaaatagtgaattataaataagtcaggccgggcgtggtggctcacacctgtaatcccagcacactgggaggccgaggcagggggactgcttgagctcaggagttcgagaccagcctgggcaacaaagtgagactccatctctatataaaaacaaaaaccacgaaagcacacacaaaataaatcagtgggatttggtaatgtgttttagagtaagaaatttcaggttgttggtgactatcccaacagtcatgttttaaatgtacagtttggggcaagtcatgtaaatactgttggtggtcttccccacacgccccaattttcaggtagtactaagagtatgtgccaggaaactcttgctattgaattgagatgattaaaatggtgacttaatccgtagttattttgcacccactgaaaggaaagtgctttccagaataatatgaagtatctaaaagtgtcaccttttcttgcctgatcaacaatttgggcttcctgtttgtacaaggggccatttggcatacctttcacagcttttatcaggccaagttaaaggctgactacattttttcatcatgaggaaagcagttgaaatgaggcatgagttactgtgcattgggattttagaacaattttcttgtgacagctctttttgtgaagttaggttcttaaaagtgcccatgatggtcacttaaaatgtgcagtaatagcactgccaggatcaagcatgaaaggcttttaaattagatcatcccacagacaatacgtttgataatagttttttcttttaacctctttaagtattgattctgcttgagaatattgaagtacttgccagaagttgtggatttcagttttaacaaatgctattaaagtggagaagcacactctggtcttggaattccatttgaggatttagaagtgtcatgtttataactattcagttgtgtttgttgctggcttgttgtaaagcaataaaatttttttggtctttttgtaag

SEQ ID NO: 192890 - DNA, 560 bp, Homo sapiens
  Payload ID: 18075
  Gene Name: translin
  ENST ID: ENST00000490717
  CDS Start-End: 121-231
gtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggcgagccccctcccttccccattccctttgcctttccatgcctagttgggccacttcgcccggccctcctctgtcgctcagtctcgggcggtggggacgcctccgaggttccaaagaggtgtttgaaagctcgagaacattttggtacagtaaaaacacatctaacatctttgaagaccaaatttcctgctgaacagtattacagatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctca

SEQ ID NO: 192891 - DNA, 578 bp, Homo sapiens
  Payload ID: 18075
  Gene Name: translin
  ENST ID: ENST00000478165
  CDS Start-End: 121-231
gtaagaccggggggacgcggcggtagcggcggccgttgcgattgattgcgctggttgcctgcggcgtccacttccttggccgcccttgctacactggctgattgttgtgcagccggcgccatgtctgtgagcgagatcttcgtggagctgcagggctttttggctgccgagcaggacatccgagaggcgagccccctcccttccccattccctttgcctttccatgcctagttgggccacttcgcccggccctcctctgtcgctcagtctcgggcggtggggacgcctccgaggatttcatgagcactggaggtttgtgttgcagcgcttggtcttcttggcagcatttgttgtgtatttggaaacagaaacactagtgactcgagaagcagttacagaaattcttggcattgagccagatcgggagaaaggatttcatctggatgtagaagattatctctcaggagttctaattcttgccagtgaactgtcgaggctgtctgtcaacagcgtgactgctggagactactcccgacccctccacatctccaccttcatcaatgagctggattccggtt

SEQ ID NO: 192892 - DNA, 2650 bp, Homo sapiens
  Payload ID: 18076
  Gene Name: translin-associated factor X
  Uniprot ID: Q99598
  ENST ID: ENST00000366639
  CDS Start-End: 159-1031
acgtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactgaagacaatgggaaagaaaataaaactccctcctctgatgcacaggataagcagtttggtacttggagactgagagtcacacctgtcgattaccttctgggagtggctgacttaactggagaattgatgcggatgtgtattaacagtgtggggaatggggacattgataccccctttgaagtgagccagtttttacgtcaggtttatgatgggttttcattcattggcaacactggaccttacgaggtttctaagaagctgtataccttgaaacaaagtttggccaaagtggagaatgcttgttatgccttgaaagtcagagggtcagaaattccaaaacatatgttggcagatgtgttttcagttaaaacagaaatgatagatcaagaagagggcatttcttagaatctaacgttactcagttactaattcttttgagaactcctaagagaccaatttgtaagacttatttagtatttcatttaactttattgtggcttttacatagaaacatattcagttgtacttgttttaaattgtatacaagctgtacataaaattagccaaatgaatcatttcttatatcttattcatgaaagtttgcatacagatgtttgcatatatgcctttttgaatttttgctggttaacctttatcatttatctttgtaatgtgaacatgcttcagagtgtaccttttgccataacctattttaatttactttttctgaagtttggagtgataatttttagtggaagcaatttgtaatttaagttggtagttatattatatatagaaaagattttttagttaaacttctggacatgagcgtcctgtttaaatttcttgttaatatcgtgccaagcctcaaaaataggcttattccatggaacaagaattaaaaatgaataagctatcaatatataatttaagtacaagtttaggctgggcgtggtggctcacgcctgtaatcccagcactttgggaggccgaggtaggcagatcacgaggtcaagagatcaagaccagcctgaccaacgtggcgaaacctcgtctctactagaaatacaaaaattagctggatatggtggtatgtgcctgtaatcccagctacttgggaggctgaggcaggagactcgcttgaacctgggaggcagaggttgcagtgagccgagattgcgccactgcactccagcctgggtaacagagcaagactccatctcaaaaaaagaaagaaagaaaaaagaaagtacaagtttataaagtattatagtgaaaaattcgcattctggctgattttaagccatttaaaatttatataaaacaaccttccataaaaatttgacaggtgcccagatgttgctttctccatttattttttgtttttttttaatcacagtaggtctgatagagaattggagctaaattataatatttttgttggtaaagttgagttatatacttgtacatacaatggaaatgcttttagtagtgattatttagcaatttttgtttttgttatattaggcatgtttggaggctttcctattctagcatttaaatttaaattttattaaaattaaataatttaaatctagcatttaaatttaaataatttaagtctagcatttacttttaaataattataatgaagttttgaaatactaagttaatccagacctttagttgtcccatggtgttaataaagttgccaaagaagatgtattatgaacaattcagcaataagacaattgtcaacacagttgagaataacaatggtaatcgttagtaatatttagaattggaatttgcctactgaaatagttatagatgattacttgtgatgtgaaactgaattgagcatgacaaccagacatttccagttggttttgtaagttttgagaatctagatactgggttttattttttgaaagattagctctgtttgtaagggctgattccttgaaaatgtaattttccagaaaaacacctaaagaaaataaaacatggacatgcctagtaaa

SEQ ID NO: 192893 - DNA, 646 bp, Homo sapiens
  Payload ID: 18076
  Gene Name: translin-associated factor X
  ENST ID: ENST00000413309
  CDS Start-End: 157-646
gtgagaggagacttccggccactgcgttgtagtcggcccggctgcaaagcgtttttctgcaggctgttttcccaggttccctcggcctgtacctcgcgcactcctcttgctccaggtccttcagtctccgctcgtctcaccgtaggctgtgacgacatgagcaacaaagaaggatcaggagggttcaggaaaaggaagcatgacaatttcccacataaccaaagaagagaagggaaggatgttaattcatcttcacccgtgatgttggcctttaaatcatttcagcaggaacttgatgcaaggcatgacaaatatgagagacttgtgaaacttagtcgggatataactgttgaaagtaaaaggacaatttttctcctccataggattacaagttcccaatatcttgatcatagtgctcctgatatggaagatatattgactgaatcagaaattaaattggatggtgtcagacaaaagatattccaggtagcccaagagctatcaggggaagatatgcatcagttccatcgagccattactacaggactacaggaatatgtggaagctgtctcttttcaacacttcatcaaaacacgatcattaattagtatggatgaaattaataaacaattgatatttacgactg

SEQ ID NO: 192894 - DNA, 2429 bp, Homo sapiens
  Payload ID: 18077
  Gene Name: translin-associated factor X interacting protein 1
  Uniprot ID: Q2TAA8
  ENST ID: ENST00000388833
  CDS Start-End: 378-2354
gctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaatcca

SEQ ID NO: 192895 - DNA, 1284 bp, Homo sapiens
  Payload ID: 18077
  Gene Name: translin-associated factor X interacting protein 1
  ENST ID: ENST00000431934
  CDS Start-End: 1-1284
cggtaccacagcttctcgtccgcgtcgagattacagccacggccttcaggagtgaccatagacgaatcctttctcacagaagacaagagcacccagaatcgcaagcttcttcagaaacgaaggacgctggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgg

SEQ ID NO: 192896 - DNA, 2338 bp, Homo sapiens
  Payload ID: 18077
  Gene Name: translin-associated factor X interacting protein 1
  ENST ID: ENST00000415766
  CDS Start-End: 386-2317
gtagtataaccgtcctcagccataagcctgtcccatcgagacgtcgggacaccgaaaactaccattcccgccggcaaagcggctccggcctctcagcacacttccctccccatggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctggagctgccagcagcacccctttcgcactgccaagccccagtacttggaggaactggaaaactacctacgcaaggagctcctcctgctggacctgggcacagattccacccaggaactaaggctgcagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgt

SEQ ID NO: 192897 - DNA, 555 bp, Homo sapiens
  Payload ID: 18077
  Gene Name: translin-associated factor X interacting protein 1
  ENST ID: ENST00000565148
  CDS Start-End: 43-555
ttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcaggtgaccaaactgaggaagaacttggctgaggagtacctgcactacctcagtgagcgagatgcctgtaagatcctcatcgcagacctgaatgagctgcggtaccagcgggaggacatgtcattagcc

SEQ ID NO: 192898 - DNA, 619 bp, Homo sapiens
  Payload ID: 18077
  Gene Name: translin-associated factor X interacting protein 1
  ENST ID: ENST00000563363
  CDS Start-End: 51-344
accacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtga

SEQ ID NO: 192899 - DNA, 2517 bp, Homo sapiens
  Payload ID: 18077
  Gene Name: translin-associated factor X interacting protein 1
  ENST ID: ENST00000568990
  CDS Start-End: 243-668
ggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaaggtgagggcagccggcagggccccaggtcctgcttacatgtgggcccagactccagctccctctccccacatgcagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaatcca

SEQ ID NO: 192900 - DNA, 2258 bp, Homo sapiens
  Payload ID: 18077
  Gene Name: translin-associated factor X interacting protein 1
  ENST ID: ENST00000561639
  CDS Start-End: 46-2184
agcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgactggtcagttctccatgggtgggcacctgtccccatggcccacatacaccagtggccagaccattttgcaaaatcgaaaaccctgttcagatgactaccggaagcgagtagggagctgccagcagcacccctttcgcactgccaagccccagtacttggaggaactggaaaactacctacgcaaggagctcctcctgctggacctgggcacagattccacccaggaactaaggctgcagccttacagagagatctttgagttcttcatagaggacttcaaaacgtacaagccattactatcctccatcaagaatgcgtatgaggggatgctggcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaatcc

SEQ ID NO: 192901 - DNA, 2228 bp, Homo sapiens
  Payload ID: 18077
  Gene Name: translin-associated factor X interacting protein 1
  ENST ID: ENST00000466164
  CDS Start-End: 273-458
ggcctctgttcatccccctgcctcagttctggtacctggggtcaaatcggctgtagtggttgactctcagggcacccgctgccgggtcccagtccacctttgctactttgtcctactcccagcccgcgggcgctaggctcgggggcgtggcgcatccctgactccgcccccgccgcgggggggcctctggggcctggtcgccatggcgaccggctgtacgctaccacagcttcccaggccgcgggtgctgattgcccgcctgcccgtgggtcatggcctgccagcagtcgcggtaccacagcttctcgtccgcgtcgagattacagccacggccttcaggagtgaccatagacgaatcctttctcacagaagacaagagcacccagaatcgcaagcttcttcagaaacgaaggacgctgcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtcgccaggcatctggggggaggaccctgtgaagttaaccctggctcttaagatgacccggcaagacctgacccgcacgcagatggaactcaacaacatgaaggccaactttggagatgtggtccccaggagggactttgaaatgcaggagaagaccaacaaggatcttcaggagcaggtgctggcaggcaggcagggccaggagggtaggacggggtctcacaggtggggggccagggccaatgtccttgcccacagctggacaccctgagagccagctacgaggaggttcgcaaggagcatgagatcctcatgcagctgcacatgagcacgctgaaggaacgggaccaattcttctctgagctgcaggagatccagcgcacttccacgccgcggcctgactggaccaagtgcaaagatgtggtggctgggggcccagagcgctggcagatgctggctgagggcaagaacagcgaccagctggtggacgtgctcctggaagagattggttcggggctgctgcgggagaaagacttcttccctggtctgggctatggggaagccatccctgcttttcttcggtttgatggcctcgtggagaacaagaagccaagcaagaaggacgtggtcaacctcctcaaggatgcctggaaggaacgtcttgctgaggagcagaaagagacgttcccagatttcttcttcaatttcctggagcatcgctttgggcccagtgatgccatggcctgggcttatactatttttgaaaatatcaagatcttccactccaacgaggttatgagtcagttctatgcagtcttgatgggaaagcggagtgagaatgtgtatgtcacccagaaggagacagtagcccagctgctgaaggagatgacaaatgctgacagtcagaacgaggggctactaaccatggagcagttcaacactgtcctcaagagtaccttccctctcaagacagaagagcaaatccaggagctgatggaggcagggggctggcatcccagcagcagcaatgcagacttgctcaactaccgctcactgtttatggaggatgaggagggccagagtgagccctttgtgcaaaaactctgggaacaatacatggatgagaaggacgagtacttacagcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcaggtgattgacatcaggcgtgtgggacctcgagagccagagcctgcaagctaggaacttgtgggcagcctgcgtactccagtcctgctaacccctagcttttaatataaaagtgtttgtctgaa

SEQ ID NO: 192902 - DNA, 834 bp, Homo sapiens
  Payload ID: 18077
  Gene Name: translin-associated factor X interacting protein 1
  ENST ID: ENST00000567852
  CDS Start-End: 596-834
cttcccaggccgcgggtgctgattgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcacccagaatcgcaagcttcttcagaaacgaaggacgctggagctgccagcagcacccctttcgcactgccaagccccagtacttggaggaactggaaaactacctacgcaaggagctcctcctgctggacctgggcacagattccacccaggaactaaggctgcagcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgcagagcgaggtgaccaaactgaggaagaacttggctgaggagtacctgcactacctcagtgagcgagatgcctgtaagatcctcatcgcagacctgaatgagctgcggtaccagcgggaggacatgtcattagcccagtc

SEQ ID NO: 192903 - DNA, 816 bp, Homo sapiens
  Payload ID: 18077
  Gene Name: translin-associated factor X interacting protein 1
  ENST ID: ENST00000565558
  CDS Start-End: 1-370
gcagctaaagcaggagcttggcatagaactccatgaggaagtgactctgcccaagctgcgagggggcctgatgaccatcgaccccagcctggacaagcagacagtgaacacctacatgagccaggccttccagctccctgagtcggaaatgccagaggagggtgacgagaaggaagaagccgtggtggaaatcctccagactgccctggagcggcttcagcggggagagctttccccaaaggccagcaggggaaaacccaaccttacttggaggagccagggaagtatctcgcagatcccgcaaaaaggcacccacgtctacagctcggcgggctggaggtctgcgggccaagccaggcctctgcactgactgtggctgaagaggtgtggcaaaggtcaggttgagggatctggtgaggtggggaggcacagaggaaagtcaggtacctgagacccagtttgcccacagatccctccatctgccctggggctctcatctcttagaacagatgctgtgaggctaaaactggtaggaagtagtatgggcagattccatcccaggcagcacctccctccccaagtctctcctccacccactcccagaacaggaaacacccagagcagcacctggtgagggaagaggcatcagcattcccttgaggctctgtcagcaaccggcaagagaatgtaaaagaagaaaaccatgggttggaccgcctgcggtgctggcactggcttcactaccgactcaggcatcaggatggaagattctggggctgcagaaacaccaaggagagggtggggctgacagaacag

SEQ ID NO: 192904 - DNA, 547 bp, Homo sapiens
  Payload ID: 18077
  Gene Name: translin-associated factor X interacting protein 1
  ENST ID: ENST00000561654
  CDS Start-End: 448-547
attgcccgcctgcccgtgggtcatggcctgccagcagtcgcggtaccacagcttctcgtccgcgtcgaggtaggcgctggcagggatgagggcagagatgagggtttgagtacttctagagagggaaatggcacttgatccggacctctgcacctcctgctggcctctgaccattgatctagggctccagcaccacagagtcaatggttagaatcgggctgatttagcccagtgaagacgttacgtgctagcaaaacgattacagccacggccttcaggagtgaccatagacgaatcctttctcacagaagacaagagcacccagaatcgcaagcttcttcagaaacgaaggacgctgcccaccaaagggagaagattcgggctctggagcccctgaaggccaagcttgtcactgtgaatgaggactgcaatgagaggatcctggccatgagagctgaggagaaatatgaaatctccctgctcaagaaagagaagatgaacttgctaaaactcatcgacaaaaagaatgaggagaagatttcattgc

SEQ ID NO: 192905 - DNA, 680 bp, Homo sapiens
  Payload ID: 18078
  Gene Name: translocase of inner mitochondrial membrane 10 homolog (yeast)
  Uniprot ID: P62072
  ENST ID: ENST00000257245
  CDS Start-End: 154-426
ggaagtaacccacgtgcttccgctggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgccaggcctaggctctctgtagagagtcttcaagatcccggagtggtagcgctgtctcctggtgaaggagtatttgtcacactggaatgtgactgtgtgtgtatgtatgtgtatatatatatatatatatatatatatatatataaacaagtttgttgacacctac

SEQ ID NO: 192906 - DNA, 530 bp, Homo sapiens
  Payload ID: 18078
  Gene Name: translocase of inner mitochondrial membrane 10 homolog (yeast)
  Uniprot ID: P62072
  ENST ID: ENST00000525158
  CDS Start-End: 182-454
ctcgggaggcgggtaacgttatagtatttgtcagaagttggggtctccgtgggcattgtgatccgtcccaggcagtgccccaggggtaggagagtgaacggcggcggtgggtgctgatggtgatgtctgctcccaggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtca

SEQ ID NO: 192907 - DNA, 486 bp, Homo sapiens
  Payload ID: 18078
  Gene Name: translocase of inner mitochondrial membrane 10 homolog (yeast)
  Uniprot ID: P62072
  ENST ID: ENST00000525587
  CDS Start-End: 123-395
gcgagtttgaatcaaagaagaggcgggactttcctcccggaagtaacccacgtgcttccgctggagcctctcgggaggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaagactgcc

SEQ ID NO: 192908 - DNA, 2840 bp, Homo sapiens
  Payload ID: 18079
  Gene Name: translocase of inner mitochondrial membrane 10 homolog B (yeast)
  Uniprot ID: Q9Y5J6
  ENST ID: ENST00000254616
  CDS Start-End: 71-382
gagaggttacttccggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaaggtctgtgtggttgtcttcacgggcaatcaggaagggagagagctggggaccatattctgcaatgcagccaaatccgaggaagagaaactgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattccagcctctccattcttttctcattattgcctcccccgccccccaactttgtgtaatttacttctgtattcagcagcctggatagcatatcattccatcaccccattttcttgccaccattggccatctttttgtatcattccacttattctgtcttttccattccttcattcaaactgctagagaaaaacagttgtgtaatgaatgccactaaatattcaaggcctccaacctcagccaagtcctcacaccaacacgcagtcacaccaacacacacctttatgggttcctggtccatttccttctctaattaccatggcagttattttacacctctactgctgtccttaatcccataccccaccctcatcaggtgaccctgtttccttttttagagaaattgaagctcttagacattggtttccacagtaataattttaaaacttcttacaactacctacaaagcagatgttctatcctatctacagagcagaaaattgaaattctcaagtagcagacccggtattaaagtgcagatctgactttaaagtccatgttcattttacacagcaggctgcctcttaagatagtatttattgagcacacactttgtgtaggttctgattttggtagatgtcatgctttatattaatctttacaacaactataagtaagaggtattaacctcacttaacagatgaggaagcaagaatccagaatgtgccagaaggcacattctgcagatttcgtgcaaacatttatacacagcttcttttttttttttttgagacagagtctcgctctgtcacccaggctggagtgcagtggagcgatctaggctcactgcaacctccgccacccgggttcaagcagttctcctgcctcagcctctcgagtagctgggattacaggcatgcgccaccacgcccagctaattttgtttttgtattttaagtagagacggggtttcactgtattggtcaggctggtcttgaactcctgaccttgtgatccgcccgcctcggcctccaaaagtgctgggattacaggtgtgagccaccacggccggcctatacaaagtttcttattgagaaaagtggttccaatcatgttttttgccccctttagctgctatctcttgaacagaaaagtttgttaggaaggtaaaagttgctgactaggaccttacccacagggtggcactctgtccttgggaaatataaatgcaagtaaaacaggtttgaacttcttaacttccagaagataggaggatgggacctgtgatactgtgctgctggtgggaggacccttccacatcaacatttgtgtgtatccttgcaataaacttccattgtgaat

SEQ ID NO: 192909 - DNA, 516 bp, Homo sapiens
  Payload ID: 18079
  Gene Name: translocase of inner mitochondrial membrane 10 homolog B (yeast)
  ENST ID: ENST00000531462
  CDS Start-End: 12-227
ccggtggcgtgatggagcggcagcagcagcagcaacagcaactgcgaaacgaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttgggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaa

SEQ ID NO: 192910 - DNA, 809 bp, Homo sapiens
  Payload ID: 18079
  Gene Name: translocase of inner mitochondrial membrane 10 homolog B (yeast)
  ENST ID: ENST00000530751
  CDS Start-End: 17-232
atgcgccggtggcgtgatggagcggcagcagcagcagcaacagcaactgcgaaacgaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttgg

SEQ ID NO: 192911 - DNA, 608 bp, Homo sapiens
  Payload ID: 18079
  Gene Name: translocase of inner mitochondrial membrane 10 homolog B (yeast)
  Uniprot ID: Q9Y5J6
  ENST ID: ENST00000533379
  CDS Start-End: 10-321
ggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttgggagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaaca

SEQ ID NO: 192912 - DNA, 1973 bp, Homo sapiens
  Payload ID: 18080
  Gene Name: translocase of inner mitochondrial membrane 13 homolog (yeast)
  Uniprot ID: Q9Y5L4
  ENST ID: ENST00000215570
  CDS Start-End: 362-649
gtgcgcatgcgcggcaggcccttcgggacgagctggaggcagagcgtgagtacaaagtgatcggcctcggccgcacgtagtagcccccctactccccggccaagtcagggcctccctcttcccgcggagtcgcaaccacgggtagctcgtgtaggtaacggcaggtccaggcctccgcatgagcggagggccccccgcgcgaccttgaatggcccgggcgcgcgcggtcgtgtgggagttgtagtcctccgtccccgtccgcgcggactccgtttcccgtggtgccccgggcggcccgcttccggcgcagttagttacgagtcggcgcacgcggcctcggtccggttgactttgcggagccatggagggcggcttcggctccgatttcgggggctccggcagcgggaagctggacccagggctcataatggagcaggtgaaagtgcagatcgccgtggccaacgcgcaggagctgctgcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacggagagaaacctctttatttccctcctgaggggtctctgggaagaggtgacgcgtgtccctggaaccccagctcggagggtctcagcctcccctgggttgggagaagtccatctttccccttagtgccaccgggctgctgagtcacgaggaatgtgttgctgctgccacccctgccccaaaggctaagggggacagccttccccttgtcagggcttgctttgaccctgcttcgttccaccccgggtcctggtggagcaccaggcaggtggtcctcgctgtgacactgaggtgctgagccagtgagctagggtggaggggctgtgtttattggaacaaagggtggtaccaaaatgcatccccatgacccacagcccccccacacccgtccttgggtagggtacggtggggtggggtgttgggtggcctgctgctcctgttgctttcacgtagagtctcggcctgggcagtcacgtggtggtcactcctggatgtgctgtcctatccagcctctcacagctgccacccgggtatagacacctgggaagtggggccggccacagccatagccccagctagtgaccccagttagcacccaccgtccagagggctccctgcaggccaggggtcccccagcgtcaccctgttggggagagaagaaagggggttcagaggccggtacctcccctacagcagcccttgggtcattggcccctctaggagtgaccctagtgacttcccctgggagccgcattttcactatctggaaaatgggctcaatgcaaaggtggcagacatttatggacacccgccacgtggtcccggagtggaacggtgcctcccactgcagcctctgcctgctctgccgccgaggcccggggatgggatgcggtgggttgcccaataaacggctgtggagtggaaattcctccagagccaaaaaggc

SEQ ID NO: 192913 - DNA, 631 bp, Homo sapiens
  Payload ID: 18080
  Gene Name: translocase of inner mitochondrial membrane 13 homolog (yeast)
  ENST ID: ENST00000591871
  CDS Start-End: 6-248
gagccatggagggcggcttcggctccgatttcgggggctccggcagcgggaagctggacccagggctcataatggagcagaggatgacggacaagtgtttccggaagtgtatagggaaacctgggggctccctggacaactccgagcagaagtgcatcgccatgtgcatggaccgctacatggacgcctggaacaccgtgtctcgcgcctacaactcgcggctgcagcgggaacgagccaacatgtgaccggcgagcgcgggccaccccaccctgttcatttccataaacgtgctttgagaggcggggtccgcatgtacgtactgcctgcccggggcttaggagggtggcaccggtgctgggacacacgggactgtgtcctcgccaccccccgccctgccccctgccagccagtgcagcttggatctcgggggtgtggggccctgtgccttcctgaagtgctggcagcccagtggcacctccttcaggcctttggggtattcccctagtgtgcccaagtcagcctcatattctgggcggacagcttgtctggacttcggagttgggggtggtcagacaccacaggagctgtcacctcctgcggatgggcaaataaattggtggaggacgga

SEQ ID NO: 192914 - DNA, 1659 bp, Homo sapiens
  Payload ID: 18081
  Gene Name: translocase of inner mitochondrial membrane 17 homolog A (yeast)
  Uniprot ID: Q99595
  ENST ID: ENST00000367287
  CDS Start-End: 37-552
agcttgcccggcatcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttccaagtcctctgcataaacgatgtattttggggtctggttgggcctggaaaatggatgagcacttcagaacaggtcattttcctgatattggaagtgacatgtggccctataggaggcatgatgttagttaattacacatttgcctacatctgtgggaaatggagaacaaagccatgtgggtactgtaaacacacgtttatcttttggcccaatgccatacatatggtaggcatttaattactgattgtgtttggataatttgggaattttcgactgtggtaaaatatacataaaataatacttattaa

SEQ ID NO: 192915 - DNA, 950 bp, Homo sapiens
  Payload ID: 18082
  Gene Name: translocase of inner mitochondrial membrane 17 homolog B (yeast)
  Uniprot ID: O60830
  ENST ID: ENST00000376582
  CDS Start-End: 150-668
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccatcgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccta

SEQ ID NO: 192916 - DNA, 1099 bp, Homo sapiens
  Payload ID: 18082
  Gene Name: translocase of inner mitochondrial membrane 17 homolog B (yeast)
  Uniprot ID: O60830
  ENST ID: ENST00000396779
  CDS Start-End: 150-818
tgggggagcagagggcagcacttcctccagctccaaaagagtgcacccaccccaacgttaccaatacactcgtgcaggcggaaagctccgacgccggtgtgcgtctacgctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgtttgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccatcgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgcct

SEQ ID NO: 192917 - DNA, 1528 bp, Homo sapiens
  Payload ID: 18082
  Gene Name: translocase of inner mitochondrial membrane 17 homolog B (yeast)
  ENST ID: ENST00000466995
  CDS Start-End: 23-193
tgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttagacggggtttcaacgtgttgcttaggctggtctctaattcctgaactcaagtgatccacccacctcagcctcccaaagtgctgggattacaggtgttagccactgcgcattttacctagaggcagattctggctcagaaacccggatagaggaaaatgacaggaatttaattggcagacggaagacagccttgaagttgagagaattcttttaacataattctttttctctgaccacctcccctcccagaagatcgcaaatgccatgactttaaatgccatctattagccaaggtctctgcaatttatatatgtagccccgtccctcccctagactcctggaactctcctccctggatctttgcccaagtttgtcatcctcaaggtctcagcacagattccccctccttcaagaggcctttcctgacccctcagccccagtcatatttcttcatggcatttcctctacagtgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccatcgactgtggcctggtgcggcttcggggcaaggaggatccctggaactctatcaccagtggagcattgaccggggctgtgctggctgcccgcagtgagtgacccctggccctggccccagccccttccaccctgttctgcctgctctcacctctgtttctctgcctccaactcccccaggtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgcc

SEQ ID NO: 192918 - DNA, 939 bp, Homo sapiens
  Payload ID: 18082
  Gene Name: translocase of inner mitochondrial membrane 17 homolog B (yeast)
  ENST ID: ENST00000495490
  CDS Start-End: 85-663
gctgggggcgtggcctgactgcgcggccagacgccagcgccatggaggagtacgctcgggagccctgcccatggcgaattgtggatgattgcggtggagccttcactatgggtgtcatcggtggcggagtcttccaggccatcaagggtttccgcaatgcccctgttatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccatcgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaa

SEQ ID NO: 192919 - DNA, 964 bp, Homo sapiens
  Payload ID: 18082
  Gene Name: translocase of inner mitochondrial membrane 17 homolog B (yeast)
  Uniprot ID: O60830
  ENST ID: ENST00000465150
  CDS Start-End: 14-682
agacgccagcgccatggaggagtacgctcgggagccctgcccatggcgaattgtggatgattgcggtggagccttcactatgggtgtcatcggtggcggagtcttccaggccatcaagggtttccgcaatgcccctgtttgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccatcgactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccta

SEQ ID NO: 192920 - DNA, 666 bp, Homo sapiens
  Payload ID: 18082
  Gene Name: translocase of inner mitochondrial membrane 17 homolog B (yeast)
  ENST ID: ENST00000490755
  CDS Start-End: 190-666
ggaggagtacgctcgggagccctggtacggcaatgggcacaggcatccggaatattgctgcgacgccaaggccagccgtgggggtcgggcgggggaggcatcggccgcacagagccatgtaccagactcgggggactcttaacgtatctcccgctacccccactcggttcctgtcattcgggctccgttatgaggggccacaaccagagaagcccatggcgaattgtggatgattgcggtggagccttcactatgggtgtcatcggtggcggagtcttccaggccatcaagggtttccgcaatgcccctgtttgcagattgctgtctgaagctcccttgtttatctactcttgctcaagatctgtgtctcccaccgttaatgtgagctctgagagggcagagagcagacctaccttgttcatggctgtatccctgcatatggcatggtgcttggcacatataggaattcggcaccggttgagaggtagtgccaatgctgtgaggatccgagccccccagattggaggtagcttcgcagtgtgggggggcctgttctccaccatcgactgtggcctggtgcggcttcggggcaaggaggatccctggaactctatcaccagtggagcattgaccggggctgtgctggctgcccgcagtggcccactg

SEQ ID NO: 192921 - DNA, 3095 bp, Homo sapiens
  Payload ID: 18083
  Gene Name: translocase of inner mitochondrial membrane 21 homolog (yeast)
  Uniprot ID: Q9BVV7
  ENST ID: ENST00000169551
  CDS Start-End: 299-1045
cgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactgcataatgtctgcagaataaaattaaaactaacaaatatgtcattagcagctgccctccgcatactttggaatctgacttgagataagcatgtgaaaatggttgagggccatagggaaccagatggtaaatacattcttcaaaattgtgtgagttttaggaatctgtctcatatttcgcgcttcatgaattaagggcctagtacatagcgggaaaagtacacactcccaagttgggtagacctgggcacccaccccaccttttctagcaggtgcgtggtcaagtgtccctgttgtgtgggttgttaggatggcagtgtgatgagaggtacaagcctggaccatagaaggcagccatgaagtgccctcatcccctttagaacttacttgcactgatacttctgactgccaaaagaacatgggagtgaatgagagacattcaaatacgtgtgtgaggccccttaaagaaaaaaaaaaaaaaaaaggaaattctattttatttgaaatatttgctggggatttggaaaaaagtgaccttcacttacaagatcctgattccatatctatgtaagtgctatgtgcattgggaggggtctagaaccatgtttatctgcggtggcttcagtgtgaggtatcccctctgatgtgtttgttccttctccccgagaactgtctgtagaggaatttctgatgtgttcttgaaattttgggatattcaggatagagagacctccaggcaatctatctcccctttttactttatctccctgcttaatttagttagtttcttggtttgactgcttgttttagatgtttttaattataaaaatttccaacatttaaggagtatagaaaatataacagacactcgtctccctgacgtaacacactttgactgaatgaggccttaacttaggctttctctcctaatcgttttttcctttgctatagaatgttcagtttcaggattcactgaaatgtcaacatttaacaggctgagaagttccacttgctatcctaaactcaaaaaagcagccctgctcttcaaacaacctgctcaaactgtagcttgctgaagaagcccggcatctgagctcaggtggggatttagccaccctccatggccctgtcatttgacttaagactgtttgctttttctgtattcatttttatgcacctgccattttacaatatgctcatgcccctttaagatctgagcttttggccaggcgaggtggctcatgcctataatcccagcactttgggaggctgaggcaggtcaatcactggaggtcaggagttcaagaccagcctggccaacatggtgaaaccctatctactaaaaattcaaaaaaaaaaaaattaaccaggcacgttgacacactcctgtaatctcatctactcaggagacaggagaagcgcttgaacccaggaggcagaggttgcagtgagccaagatcatgtcactgcactccagcatgagtgacggagtgtgacttcgtctcaaaaaaaaaaaacaaaaaacagatctgagcttttataattagaaataaaactaaattactttttcaaaaggaaaaactctgtaccaataagagattcttctgtatagccacaggaaaatgtgatgtgtaactctctagatctctgttttcattccctctgatgtaccctactaaatgttaaaatttctgtgttttaagaccctctttaatcc

SEQ ID NO: 192922 - DNA, 2524 bp, Homo sapiens
  Payload ID: 18083
  Gene Name: translocase of inner mitochondrial membrane 21 homolog (yeast)
  ENST ID: ENST00000580087
  CDS Start-End: 287-805
aggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgagggctgttcttcacacagaccaaggagtaatgtcatagctcgcatttgcagcccctgaagaggagaaagatttcaatccacagcgtgctcagtatagagcccggtgctgatcttccctggggccccggctctgaatgttctaccagttttctaatcatgtcagggtggaaacctcagaagctaacgatctctggcatctttccttttaaatccactgatttctcttcattgagctctggacagccagtggtaaccatggagaaaggcagggaggataaagtatctcagaggtgaaaaccaggaaataaggaaggttcgttcccataatagttactgggaatccaaattttatctgacaagaaacattctttacagactccggaaatacctgtgggtggtaacctcattaaatgttaggacgcatctctggaaagagatgaagagttgctgttttattcgcaaactcagcctttcgtagatttttcagcattttgaacaaaaaactccacaagaatatacaaaagtgggatattattgaagtcgtaacttcatttgctgcctgaaaaaactctacaaataataattaaactttaacaattttgtcaacattttttaaggggtacccttctctttgctgggtactgtgtctgcttgaaaaacaaaatcttgatggatgttgatatttatatgtttaatagattaaagtaaattgttctatttgtttgtgctatacaattctgcaatatcatcttacatattacttctttttatcctggaaaatgtgatactgaagatactccacaaacagacaaaataagataaatttcgtagagttgagggtcaaacttttttagtttaatatcaaatttatattttttagagggttccacagtatttgcattttgaattcaataaaaactacatttctacttcatgtggattttctcattagaaatagtagattcacacctgtagctctgatttattttaaatgtcattatctgttttctttttcctcactgtgtttggtaactttaaaaattttttgatctcatagttttagtattagatgctattaattaattacatttcattaaaaatgttcatacattttatcttcaaaccataaggggttagtagagaaacatctgaactctgtgttgttatgtttgttttctgtaagaggagcaggaactgcgtcatgtcaacctacattgctttgaaactacaagtcacaccataaagctacctattttaatctttgtgcatgaaatatttgtttaaattatttatgggatgatttttgtataataacccttttttcagttttcttattggagtggtcatttttttatttgtttgtttgtttgtttgttttgagacggagtctcgctctgtcacccaggctggagttcagtggcacgatcttggctcactgcagcctctgcctactgggttcaagcgattctcctgcctcagcttcctgagtagctgggactacagatgcgcatcaccatgcccagctgatttttatattttttagtagagacggggtttcacctagttggccaggctagtcttgaactcctgaccttgtgatccacccatcttggcctcccagattgctgggattataggcgtgagccaggagtggtcatttttgaaaaggtcctaagcttactgatttttttttcctaaaatcatctggtttgttaaaaattatttctttagaagcttaaaaaaataacacaaaataaagcactgtccttgttctgca

SEQ ID NO: 192923 - DNA, 821 bp, Homo sapiens
  Payload ID: 18083
  Gene Name: translocase of inner mitochondrial membrane 21 homolog (yeast)
  ENST ID: ENST00000579071
  CDS Start-End: 1-383
taatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagaggtgtgggaatcatgggatgtggggtcagaggttctgagcgcggtgttatttaagttctggaaaggaaaataatacctggaaacactacatttttttcagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagatttta

SEQ ID NO: 192924 - DNA, 3194 bp, Homo sapiens
  Payload ID: 18084
  Gene Name: translocase of inner mitochondrial membrane 22 homolog (yeast)
  Uniprot ID: Q9Y584
  ENST ID: ENST00000327158
  CDS Start-End: 27-611
cgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatattaaaaaaaaaaaaaaaaaaatccgtctacagttgggcttcagcactggtgctgctttaccctggtgctctgtggggggatgacactgctggagtcaggcctttgctcttgggtggggcacaggcaggtcgcttggtgggggccacacagtgctgggcaccttcagccagtggtgatgagtctcctttttcctataatacggtaattcctctatcctttccttttttgccttcttcctcatctgccctgtcttctggcccacacactcttaaccagcgttcacactcagtgtacatggcctggaggcccgagtgtttgtacatgagtgatgatgtcaaacccagctggtaacaccttccttgggtcatgtttgccattttcttggaatgaatgtgagttcctgctcagggctcatgtccttttacagtgaattctatataacgcccctcccagtctcacagctaggaggcttcatcactgctaggccagttggagcgttccctagagctcagaacaaattgtttcctctgctgtccctaaatataggacacctacaagcactctgaagcaagggcagacattcccacctggtacctgtcaaagtcctaggatgcctgggatcttccatctttcagtctagcacgtgggaccaaatacaagagatgctgccctcacaacagccttggaaaagatgagcgccagggctgtcagtacccatcggttcagtaagcgaggcattgtccacgctgcctattcactcgagagatgaatagtttcctgttttcgatggctggggagccagtatgagctcataaaccaaacagcaattttcagagacatctgttcctgatcttcagaataaactcagtgtccagttgcttcggctggtgggagccaatattcacgccactgactctctcaaagggagggtgggccctcggagacccagcttctctgacaagcagattagaccaaaaggctgcctcaaagatatgccactttgaaggaaagcgtagagaagcgtttacataaaagaagacgcttcctgttcagtggacaacttcatgccactttcaaggcacaccgatggccaggtgggacatttgtactgtagcagcacatggcaaaggtgagccagaagcagcctggatgctggctgatccggaggcctttgtgaagagcaaggagagggctccagcccacctccccgcagctctgccccagcccccgtgggccacagggaggctcaaggggagtgaactaggtaaacagattcctggaaactcacatctggatgcagctggaagagttaaatatttacattggtggcttccctggaccaccgcgaacacaaacatccacaccacagggctgagttttgtgcaaatgatggggctttgcattttttattaacattttcctctcacgtggtttacatcaatttataataatctacataagttgaaacagaacatagacaaaaaaatatatccttaccaacttattaaagtcagatattcatgaa

SEQ ID NO: 192925 - DNA, 3194 bp, Homo sapiens; identical to SEQ ID NO: 192924
  Payload ID: 18084
  Gene Name: translocase of inner mitochondrial membrane 22 homolog (yeast)
  Uniprot ID: Q9Y584
  ENST ID: ENST00000617832
  CDS Start-End: 27-611

SEQ ID NO: 192926 - DNA, 3194 bp, Homo sapiens; identical to SEQ ID NO: 192924
  Payload ID: 18084
  Gene Name: translocase of inner mitochondrial membrane 22 homolog (yeast)
  Uniprot ID: Q9Y584
  ENST ID: ENST00000613269
  CDS Start-End: 27-611

SEQ ID NO: 192927 - DNA, 1222 bp, Homo sapiens
  Payload ID: 18085
  Gene Name: translocase of inner mitochondrial membrane 23 homolog (yeast)
  Uniprot ID: O14925
  ENST ID: ENST00000580018
  CDS Start-End: 177-806
gcgcacattgccgcaaagcggaagtgtggcgcttaacgggaaccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaa

SEQ ID NO: 192928 - DNA, 1142 bp, Homo sapiens
  Payload ID: 18086
  Gene Name: translocase of inner mitochondrial membrane 23 homolog B (yeast)
  Uniprot ID: Q5SRD1
  ENST ID: ENST00000374098
  CDS Start-End: 163-729
aaagcggaagtgtggcgcttaacgggaaccggcgcccggaatgtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcgacaaaaccacaggggtattggccggctttttcggagccggcgaagcaggttactcgcacgcggatttggctggcgtcccgctaactggtatgaaccctctgtgtccttatttaaatgtggatccacgatacctcgtgcaggatacagatgagttcattttacctaccggagctaataaaacctggggcagatttgagctggccttctttacgattggagggtgttgcatgacaggggctgcgtttggggcaatgaatggtcttcggctaggattgaaggaaacccagaacatggcctggtccaaaccaggaaatgtacagattttgaatatggtgactaggcaaggggcactttgggctaatactctaggttctctggcgttgctctatagtgcatttggtgtcatcattgagaaaacacgaggtgcagaagatgaccttaacacagtagcagctggaaccatgacaggcatgttgtataaatgtacagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatgaactgtttatttatgctgttatttttgtgtttactcacctcatttatattgacttgtaaattagtaatttctgaactattatttatcaattcattgcctacatgtcagcaaacaaattttcttcttaataaagaatccagttgctgggcacaatggttcacacctgtaatctcagcacgtttggagggcaaggcaggaggattccttggggctaggagttcaaga

SEQ ID NO: 192929 - DNA, 1152 bp, Homo sapiens
  Payload ID: 18086
  Gene Name: translocase of inner mitochondrial membrane 23 homolog B (yeast)
  ENST ID: ENST00000451577
  CDS Start-End: 115-537
gtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcgacaaaaccacaggggtattggccggctttttcggagccggcgaagcaggttactcgcacgcggatttggctggcgtcccgctaactggtatgaaccctctgtgtccttatttaaatgtggatccacgatacctcgtgcaggatacagatgagttcattttacctaccggagctaataaaacctggggcagatttgagctggccttctttacgattggagggtgttgcatgacagcgttgctctatagtgcatttggtgtcatcattgagaaaacacgaggtgcagaagatgaccttaacacagtagcagctggaaccatgacaggcatgttgtataaatgtacagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatgaactgtttatttatgctgttatttttgtgtttactcacctcatttatattgacttgtaaattagtaatttctgaactattatttatcaattcattgcctacatgtcagcaaacaaattttcttcttaataaagaatccagttgctgggcacaatggttcacacctgtaatctcagcacgtttggagggcaaggcaggaggattccttggggctaggagttcaagaccagcctgggcaatatagcaagatttcatctctacaaaaaaatgaaaacattggctgggcatggtggctcattcctatagttcaggctactgaggagcctgatgtaggaggatcacgtgaccccagtagtttgaggctgcagtgagctatgatcctaacactgctctccagcctgggtgacacaccaagttgccatctcttc

SEQ ID NO: 192930 - DNA, 1156 bp, Homo sapiens
  Payload ID: 18086
  Gene Name: translocase of inner mitochondrial membrane 23 homolog B (yeast)
  ENST ID: ENST00000483296
  CDS Start-End: 115-231
gtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcgacaaaaccacaggggtattggccggctttttcggagccggcgaagcaggttactcgcacgcggatttggctggcgtcccgcgatacagatgagttcattttacctaccggagctaataaaacctggggcagatttgagctggccttctttacgattggagggtgttgcatgacaggggctgcgtttggggcaatgaatggtcttcggctaggattgaaggaaacccagaacatggcctggtccaaaccaggaaatgtacagattttgaatatggtgactaggcaaggggcactttgggctaatactctaggttctctggcgttgctctatagtgcatttggtgtcatcattgagaaaacacgaggtgcagaagatgaccttaacacagtagcagctggaaccatgacaggcatgttgtataaatgtacagcctcggcctcccgaggtgccgggattgcagatggagtctcgttcactcagtgctcaatgttgcccaggctggagtgcagtggcgtgatctcggctagctacaacctccacctcccagccgcctgccttggcctcccaaagtgccgagattgcagcctctgcccggctgccaccccgtctgggaagtgaggagcgtctctgcctggccgcccatcgtctgggatgtgaggagcccctctgcccgggctgcccagtctgggaagtgaggagcgccttttcccggctgccatcccgtctaggaagtgaggagcgtctcggcccggccacccatcgtctgagatgaggggagcgcctctgccccgccgccccgtctgggatgtgaggagcgcctctgcctggccgcgaccccgtctgggagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgactttt

SEQ ID NO: 192931 - DNA, 2623 bp, Homo sapiens
  Payload ID: 18086
  Gene Name: translocase of inner mitochondrial membrane 23 homolog B (yeast)
  ENST ID: ENST00000478381
  CDS Start-End: 147-446
gcttaacgggaaccggcgcccggaatgtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcgacaaaaccacaggggtattggccggctttttcggagccggcgaagcaggttactcgcacgcggatttggctggcgtcccgcagtcaggacctcgttctgtcacccatgttggggtgcggtggcatgattatagttcactgaagcctggcactcctgagctcaaacaatcctcccctctaagcctcctaagtagctgggaatctagtaactggtatgaaccctctgtgtccttatttaaatgtggatccacgatacctcgtgcaggatacagatgagttcattttacctaccggagctaataaaacctggggcagatttgagctggccttctttacgattggagggtgttgcatgacaggggctgcgtttggggcaatgaatggtcttcggctaggattgaaggaaacccagaacatggcctggtccaaaccaggaaatgtacagattttgaatatggtgactaggcaaggggcactttgggctaatactctaggttctctggcgttgctctatagtgcatttggtgtcatcattgagaaaacacgaggtgcagaagatgaccttaacacagtagcagctggaaccatgacaggcatgttgtataaatgtacagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgacttttccatggaatggacaagtagtagtctctgtcagagctacattttaaaggagaaaaagaaacgtgaagtcatgaactgtttatttatgctgttatttttgtgtttactcacctcatttatattgacttgtaaattagtaatttctgaactattatttatcaattcattgcctacatgtcagcaaacaaattttcttcttaataaagaatccagttgctgggcacaatggttcacacctgtaatctcagcacgtttggagggcaaggcaggaggattccttggggctaggagttcaagaccagcctgggcaatatagcaagatttcatctctacaaaaaaatgaaaacattggctgggcatggtggctcattcctatagttcaggctactgaggagcctgatgtaggaggatcacgtgaccccagtagtttgaggctgcagtgagctatgatcctaacactgctctccagcctgggtgacacaccaagttgccatctcttcaaaaaaggaatctagagacatcagtgtgtgcacaagcatggtttgtgaatttggaagtgtgtatgtgcatagttgtgctcaagaatgtgttgatgattataccttctcagaatgaaggtaattttttttttttctttttttttgagatggagtcttgctctgttgccaggctggagtgcagtggtgctctcagctcactgcaacctctgcctcccggcttcaagcagttctcctgcctcagcctcccaagtagctgggactacaggcacacaccaccactcccggctaattttttgtgttttagtagagacggggttttaccatgttggccaggatggtctcgatcccccgaccttgtgatccacccaccttggcctcccaaagtgttgggattacaggtgtgagccaccgtgcctggcctgaaggtcatttttataaagatctctccacgtcttagatttgattcttcctttaaatatttttctcattgacatttgaaagcacctgaccttatataaaatgaacaattttcataactccataaaaggagaattatggcatcatctatttctttctcttgtctcataaatctaaaccatcaacctgcttatttttgtatactgtcacactgtgtattccctgcattgaatgcctgtctgttgacattatctgtaaaaattgtgggaagttttctgcaccctgaaatttctgttatgcggattaaatatccactatccatgtttttccaagtcttacagtagaaagggtaaatgcagccctcacagcagcctgttgttcgtcctgcaaatgtgtttccatcacattacacaaagcctctttgtcttcgtggttctaccctactaataagttttttaaaaaattatgtaatgtgtgtatatacaaatacctatatgtatgtgtgtacacatacagctgatatctgctgagattatgtatgcatgaactatagaattaacttgtaattttaagaaaataaattattttgtaaagataaatctcatgtttaagaagaggaattacagttgaatcatttagggatgcctcagcctaaacataatatggaaaaagccataaccaaaagtcattttagagtactgctaggttactcaacctatcatcacatttaattaaaatgtcagtttgaaccatg

SEQ ID NO: 192932 - DNA, 2075 bp, Homo sapiens
  Payload ID: 18087
  Gene Name: translocase of inner mitochondrial membrane 44 homolog (yeast)
  Uniprot ID: O43615
  ENST ID: ENST00000270538
  CDS Start-End: 270-1628
acagatctgaccctcccaggagtgccctcccccgggccacatccagtcacgggccccgtccttccaaaacactgccctatcagaggtcaagctctctaggcattccctacccttttaatgccccgccctatgacggacccaatcggagggctctccctacccgaaaccccgctcctggagcggcttttctcaggcttgcgcggctctaggccgaagcggcggatgacgcaaccgggccgcgccgcgagaaggtcacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataa

SEQ ID NO: 192933 - DNA, 868 bp, Homo sapiens
  Payload ID: 18087
  Gene Name: translocase of inner mitochondrial membrane 44 homolog (yeast)
  ENST ID: ENST00000595565
  CDS Start-End: 1-402
ctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaacaccgaattgcagaaga

SEQ ID NO: 192934 - DNA, 819 bp, Homo sapiens
  Payload ID: 18087
  Gene Name: translocase of inner mitochondrial membrane 44 homolog (yeast)
  ENST ID: ENST00000597926
  CDS Start-End: 1-819
atggcggcggcggccctgcggagtggctggtgccgctgtccacggtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgg

SEQ ID NO: 192935 - DNA, 1206 bp, Homo sapiens
  Payload ID: 18087
  Gene Name: translocase of inner mitochondrial membrane 44 homolog (yeast)
  ENST ID: ENST00000595876
  CDS Start-End: 17-436
cacacgattctccaacatggcggcggcggccctgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacgaggaagttgcagtgagccgagagcgtgccactgtactccagcctcggcaacggagacattgtctcaaaaaaaaaaaaaaaaaaaaggacacagcgctctttacctagaaaaccatcgagtcagaaaccgtgcggacgagcgaggtgctacggaagaagcttggggagctgacgggcaccgtgaaggagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcact

SEQ ID NO: 192936 - DNA, 1797 bp, Homo sapiens
  Payload ID: 18087
  Gene Name: translocase of inner mitochondrial membrane 44 homolog (yeast)
  ENST ID: ENST00000595831
  CDS Start-End: 1-380
tgcggagtggctggtgccgctgtccacggagatgcctcggcagtggaatccaatttctttccagccacaacctaccccatgggtcgacctatcagatgcgccggccgggcggagagctgccactgtccaaatcatattcttctggaaacagaaaaggctttctgtccggcttgctagataatgtcaaacaagaattagccaaaaacaaagaaatgaaagaaagtataaaaaaattccgtgacgaggccagaaggctagaagaatcagacgtgctccaggaggccagaaggaaatacaaaaccatcgagtcagaaaccgtgcggacgagcgaggtgctacggaagaagcttggggagctgacgggcaccgtgaaggagtagagccttcacgaagtcagtaaaagtgatctcggccggaaaatcaaggagggcgtggaggaagcagccaagacggccaagcagtcggccgagtcggtatccaaaggcggggagaagctgggcaggacagcggccttcagagccctctcccagggggtggagtccgtgaagaaggaaattgacgacagcgtcctgggacagaccgggccctaccggaggccccagcgactccggaagagaacggagtttgcgggagataagttcaaggaggagaaagtgtttgagccaaacgaggaggccctgggggtcgtgctgcacaaggactccaagtggtaccagcagtggaaggacttcaaggagaacaacgtggtgtttaaccggttcttcgagatgaagatgaagtatgacgaaagcgacaacgcgttcatccgggcatcccgggcccttacggacaaggtcaccgacttgctggggggcctgttctccaagacagagatgtcggaggtgctcacggagatcctccgggtggacccggcctttgacaaggaccggtttctgaaacagtgcgagaacgacatcatccccaatgtcctggaggccatgatttctggagagcttgacattctcaaagactggtgctatgaagctacttacagccagctggcccaccccatccagcaggccaaggcactgggtctccagttccattctcgcatcctagacattgacaacgtcgacctggccatgggcaagatgatggagcaggggccggtgctgatcatcaccttccaggcacagctggtgatggtggtcaggaaccccaaaggcgaggtggtggagggtgacccggacaaggtgctgcggatgctgtacgtgtgggcgctctgccgagaccaggacgagctcaacccctacgcggcctggcggctcctggacatctcggcctccagcaccgagcagattctctgagtgtggtgccggagccaggtagccccggcctgggtcatcaggcacagaggcaccgcaacaccacctgcggcaactccagacctctgggaacaagactgcgggctctgcccccagctctgccaggacggctgcaagaccagctggcccgggaggggacaacgggctgttgcgggtgcgcggcagctggagacactcccccgcagggccaacccctgccctgttgctctgccctgcaggggtcccggcgcctggtcacctggggtgcacacaggtcacacagtgccaagaggccccagggcccagggactccccccacagcagggtgggacccgggacccgcggctcagtggcccgctagccacgtcagccaagccactttaggtccattttttaattttaacagtgctcttccatcttgtgcataagcctgagatttggaaagaataaaaca

SEQ ID NO: 192937 - DNA, 1612 bp, Homo sapiens
  Payload ID: 18088
  Gene Name: translocase of inner mitochondrial membrane 50 homolog (S. cerevisiae)
  Uniprot ID: Q3ZCQ8
  ENST ID: ENST00000314349
  CDS Start-End: 134-1504
acaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctg

SEQ ID NO: 192938 - DNA, 2572 bp, Homo sapiens
  Payload ID: 18088
  Gene Name: translocase of inner mitochondrial membrane 50 homolog (S. cerevisiae)
  Uniprot ID: Q3ZCQ8
  ENST ID: ENST00000544017
  CDS Start-End: 134-1504
acaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatattttttttttttttttgagacagggtctcactgttgcccaggctggagtgcattgatgtgatcttagcttacaacagccttgacctcccggctcaagtgatctccaagtgaccctcctgcctcagcctcctgagtaccctcctggggactacaggtgcgtgctaccatacccagctaatttaaacaaattttttttttgtagagatggggtcttggtgcccaagctggtctcaaactcctagtcttaagcaatcttcctgctttggcctcccaaagcgctaggattccaggtgtgagctactgtgcccagctaaaatagggatttttatattaaatctccctattttaaaatgttggctcctagcggggcgcagtggctcacgcctgtaatcccagcactttgggaggctgaggtgggtggatcacctgaggtcaggagttcaagaccagcctcaacatggagaaaccccatctctactaaaaatacaaaattagctgggcgtggtggagc

SEQ ID NO: 192939 - DNA, 456 bp, Homo sapiens
  Payload ID: 18088
  Gene Name: translocase of inner mitochondrial membrane 50 homolog (S. cerevisiae)
  ENST ID: ENST00000597782
  CDS Start-End: 1-335
gcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgagacagagtttcaccatgttggccaggatggtcttgatctgacctcgtgatccgtctgcctcggcctcccaaagtgctgggattacaggcgtgagccaccgtgcccggccttatccaattctggtacagcagttgcgccggacatacaaatatttcaaagattatagacag

SEQ ID NO: 192940 - DNA, 770 bp, Homo sapiens
  Payload ID: 18088
  Gene Name: translocase of inner mitochondrial membrane 50 homolog (S. cerevisiae)
  ENST ID: ENST00000602028
  CDS Start-End: 1-770
ggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaaga

SEQ ID NO: 192941 - DNA, 680 bp, Homo sapiens
  Payload ID: 18088
  Gene Name: translocase of inner mitochondrial membrane 50 homolog (S. cerevisiae)
  ENST ID: ENST00000594583
  CDS Start-End: 1-680
ctcaggtgatacttgagcaggaggggcctgggacgctggagtcccagtctggccgtgggagttattttctctgtggcgttggtggtggcgaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaag

SEQ ID NO: 192942 - DNA, 1737 bp, Homo sapiens
  Payload ID: 18088
  Gene Name: translocase of inner mitochondrial membrane 50 homolog (S. cerevisiae)
  ENST ID: ENST00000601252
  CDS Start-End: 1-313
gaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatattttttttttttttttgagacagggtctcactgttgcccaggctggagcacagtggtgtaactatagctcactgcagtgttgaacttctgggctcaaacaatcttcctgccttggcctccccaaatgctgagattataggagtgagccactctgcccaactacttttaattaaatagccacatgtgtctcctgtattgacagtaccactgtgtattaagagtatgagtcccagattgtgtaagttcaaatccaagctctaccacttctcggctggcttgtgatcctgtgcaagttactttacctctcagtgcctcggtttctacatttataaaataataactgggcaggcacagtggctcatggctgtcatcccaacacttcaggaggccgaggtgggaggatcgcctgaggccaggagttggagagcagcctgggcaacatgggaagagcctgtctcttgcgggggggggagaagaaagttcttgtctcaggctagctttggggaccaaatgaagcactcccatgtaggcactcaaatggaactatgtaaaccttaggcaaggcacctctgcctcagtttcctcatctctaaaatggggtgatggtagtatgttagcagagtggttgtgaggagtgaacgggacagtccgtatgtgggttatatgtatatattcccaggtgcttgctgttaccaggccatatgggttattcacagattgaaatatcttagctgggcacggtggctcacccctataatcccagcactttgggagaccgaggcgggtggatcacctgaggtcaggagttcgagaccagcctggccaacatggtgaaaccctgtctctactaaaaaaatacaaataaat

SEQ ID NO: 192943 - DNA, 769 bp, Homo sapiens
  Payload ID: 18088
  Gene Name: translocase of inner mitochondrial membrane 50 homolog (S. cerevisiae)
  ENST ID: ENST00000601403
  CDS Start-End: 2-769
gatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgg

SEQ ID NO: 192944 - DNA, 1481 bp, Homo sapiens
  Payload ID: 18088
  Gene Name: translocase of inner mitochondrial membrane 50 homolog (S. cerevisiae)
  ENST ID: ENST00000601358
  CDS Start-End: 371-796
aagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctg

SEQ ID NO: 192945 - DNA, 786 bp, Homo sapiens
  Payload ID: 18088
  Gene Name: translocase of inner mitochondrial membrane 50 homolog (S. cerevisiae)
  ENST ID: ENST00000599794
  CDS Start-End: 14-487
gcgtcagcgcaagatggcggcctcggcagcggtgttctcgcgcttgcgaagcgggctccggctcggctcgcggggactgtgcacgaggttggcgacgccgccccgccgggccccagatcaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaa

SEQ ID NO: 192946 - DNA, 604 bp, Homo sapiens
  Payload ID: 18088
  Gene Name: translocase of inner mitochondrial membrane 50 homolog (S. cerevisiae)
  ENST ID: ENST00000597666
  CDS Start-End: 5-604
caagatggcggcctcggcagcggtgttctcgcgcttgcgaagcgggctccggctcggctcgcggggactgtgcacgaggttggcgacgccgccccgccgggccccagatcaggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaac

SEQ ID NO: 192947 - DNA, 669 bp, Homo sapiens
  Payload ID: 18088
  Gene Name: translocase of inner mitochondrial membrane 50 homolog (S. cerevisiae)
  ENST ID: ENST00000599733
  CDS Start-End: 1-349
gttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaaggtgagggggaaagagaccgaggccttgccaggagtcctagtctgtggattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaag

SEQ ID NO: 192948 - DNA, 786 bp, Homo sapiens
  Payload ID: 18088
  Gene Name: translocase of inner mitochondrial membrane 50 homolog (S. cerevisiae)
  ENST ID: ENST00000602265
  CDS Start-End: 1-352
gttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacc

SEQ ID NO: 192949 - DNA, 1338 bp, Homo sapiens
  Payload ID: 18088
  Gene Name: translocase of inner mitochondrial membrane 50 homolog (S. cerevisiae)
  Uniprot ID: Q3ZCQ8
  ENST ID: ENST00000607714
  CDS Start-End: 23-1084
ggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatct

SEQ ID NO: 192950 - DNA, 1664 bp, Homo sapiens
  Payload ID: 18089
  Gene Name: translocase of inner mitochondrial membrane 8 homolog A (yeast)
  Uniprot ID: O60220
  ENST ID: ENST00000372902
  CDS Start-End: 533-826
ttccctacgtcgggagaggaaaactccatcaaaaaacgaaagccaggggcccaggatagccaactaatcgacccagtcaactaactgacccagtgcacaactctggtagctcagaaaacgcgggctaatttggaagtggacaggggcggagctgtggggccagcacggaatggatcacgtggtctgaagtaacttccttttctcctttcttttctttttggagtaacatctcaacggcacctcggctctgggctgtaagccctgcgatctcaaggcgcaaggctgggcgcaacggcagggttgcggggttacgggattgcggggtccggggagtggaacccgccgactccgggaacgaagcaccggcgccaaggtgtgggaggcggcggggtggagttggacgcctgcctcgcgccgacgcagtgcactcacgggggcggtcccagaggcagctagctgtggttccggttccgtcgcggagacacgtgaaggtcggtgcggagttcgtctctgcaagcttggtcgccctgggatggattcctcctcctcttcctccgcggcgggtttgggtgcagtggacccgcagttgcagcatttcatcgaggtagagactcaaaagcagcgcttccagcagctggtgcaccagatgactgaactttgttgggagaagtgcatggacaagcctgggccaaagttggacagtcgggctgaggcctgttttgtgaactgcgttgagcgcttcattgatacaagccagttcatcttgaatcgactggaacagacccagaaatccaagccagttttctcagaaagcctttctgactgatctcagcattacctctttggaaaaggaaggtagttcaagaaatgaagagctgttgatgggatgattgaagaaacagctatgagaggattggctcccatcttttgttactcttgggacatcctgtcatctgagaatgaacaaagaccaattttttgtgtgtgaagcttaagggtcatatgtttgcttgtattttttaatgctaatcttgtgaaaataattgacaggcgaaagaaaactctatttagatgcatattactgtacatgggactatgcttttctcaaagccccattaactgcttcctataattttgatagtgggaccacatacgtaaaaatctctcatttgtgtggagtcatttctgatttcaggggagatccttgtgtttatcagaaagggcagaagtaggggaagaataatttggtatccttatctagtgtttgattgtcaatgctggagaaaaatatctgtaagagtgtttatacagtacacttcagttatcttgatctccctttcctatatgatgatttgcttaaatatccatattaagtaagtctcaaggtagggtaggcagcctgagagtctagaggcctttagttataaaggaatctagccagtgaacataattcttattactagactgccacaaggaagaaattaacttaccctgtatatcagggtacaaaaaattcagtgatgtgcctaaataagttataaagatttaggccaatcagaagctaacagcagtttcaggtagaggtgcatgcctaatgttagttagtgtagattccatttactgcattcttctgatcactgaaataaaagctatataagattcaa

SEQ ID NO: 192951 - DNA, 1155 bp, Homo sapiens
  Payload ID: 18090
  Gene Name: translocase of inner mitochondrial membrane 8 homolog B (yeast)
  ENST ID: ENST00000509359
  CDS Start-End: 76-174
aagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggccacgtgcccgtagaaaagatactcatccactgtgggttttggtgtcgccgtcaccccactgcctcactggattgtgaggatcatatgcgacaatgtatttgaaaacgactagaacattatcggaggaaggtggactctgaagtagtcgctgtagactatggatgtagaacaagggtttggagcccttcggacatggttctaacgcggcctgacttcttgctggctacatgaccttggactacataatcacgcctcttaaatgggaggtgatgacagctatccttgaggaccttagagagaactgatttcttagtacccagcctcacaaatagtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaaaaaaaaaaaaaaa

SEQ ID NO: 192952 - DNA, 819 bp, Homo sapiens
  Payload ID: 18090
  Gene Name: translocase of inner mitochondrial membrane 8 homolog B (yeast)
  Uniprot ID: Q9Y5J9
  ENST ID: ENST00000504148
  CDS Start-End: 73-324
tcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaaaaaaaaaaaaaaa

SEQ ID NO: 192953 - DNA, 805 bp, Homo sapiens
  Payload ID: 18090
  Gene Name: translocase of inner mitochondrial membrane 8 homolog B (yeast)
  ENST ID: ENST00000541231
  CDS Start-End: 31-327
aagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggc

SEQ ID NO: 192954 - DNA, 1336 bp, Homo sapiens
  Payload ID: 18091
  Gene Name: translocase of inner mitochondrial membrane 9 homolog (yeast)
  Uniprot ID: Q9Y5J7
  ENST ID: ENST00000395159
  CDS Start-End: 527-796
aagcgctctctggtgctcttccattcctctccgggtggaaacaaactccggacataacaggggtttatttatttatttattttaaggtagcacattgccgcacaagaccgctctacagtctcatccaagacttgaagagctcccgacttgtaatactacttgtgtttaccagggactgttgacactgcttcgcttccgaagaccgttagggacgtgggattagatttcctcgcgttataacgaatcggcgtctaagggtttaagtgtcacttgacattactgctcccacgtgttctttcccatctggcggccgcggctcctgtccagaccctgaccctccctcccaaggctcaaccgtcccccaacaacccccagccttgtactgatgtcggatgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactgagcagttgtttatactgtatggtaccatagtattctcactggactgtggatacgttgaaatgtttttcaatcaggatcatcctccaagcagtcctgttcattcatgtctgcctcaaattgctggtgaatacataaaatagttacttgctaatcat

SEQ ID NO: 192955 - DNA, 377 bp, Homo sapiens
  Payload ID: 18091
  Gene Name: translocase of inner mitochondrial membrane 9 homolog (yeast)
  ENST ID: ENST00000555097
  CDS Start-End: 245-377
tggcggccgcggctcctgtccagaccctgaccctccctcccaaggctcaaccgtcccccaacaacccccagccttgtactgatgtcggatgcgagagcctgtgcttaagtaagaatcaggccttattggagacattcaagcaaaggttggacaactacttttccagaacagaaaggaaactcatgcatcagaaaaggtttcagggatataatcagaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaag

SEQ ID NO: 192956 - DNA, 598 bp, Homo sapiens
  Payload ID: 18091
  Gene Name: translocase of inner mitochondrial membrane 9 homolog (yeast)
  Uniprot ID: Q9Y5J7
  ENST ID: ENST00000555061
  CDS Start-End: 169-438
taatgatctgagaaattgggggtggtggcatacaattacatacacagatttataaaatacgagcagtgattccctaactcttcagttagactaaaaacatttgtttatagattgacaaacttgttttgaatttttaaattaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgc

SEQ ID NO: 192957 - DNA, 796 bp, Homo sapiens
  Payload ID: 18091
  Gene Name: translocase of inner mitochondrial membrane 9 homolog (yeast)
  Uniprot ID: Q9Y5J7
  ENST ID: ENST00000555593
  CDS Start-End: 141-410
gctctacagtctcatccaagacttgaagagctcccgacttgtaatactacttgtgtttaccagggactgttgacactgcttcgcttccgaagaccgttagggacgtgggattaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataaatggaaatatcactga

SEQ ID NO: 192958 - DNA, 430 bp, Homo sapiens
  Payload ID: 18091
  Gene Name: translocase of inner mitochondrial membrane 9 homolog (yeast)
  Uniprot ID: Q9Y5J7
  ENST ID: ENST00000555404
  CDS Start-End: 161-430
actgctcccacgtgttctttcccatctggcggccgcggctcctgtccagaccctgaccctccctcccaaggctcaaccgtcccccaacaacccccagccttgtactgatgtcggatgcgagagcctgtgcttaagtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagagaccacctgttcagaacattgcttacagaaatatttaaaaatgacacaaagaatatccatgagatttcaggaatatcatattcagcagaatgaagccctggcagccaaagcaggactccttggccaaccacgatag

SEQ ID NO: 192959 - DNA, 746 bp, Homo sapiens
  Payload ID: 18091
  Gene Name: translocase of inner mitochondrial membrane 9 homolog (yeast)
  ENST ID: ENST00000556007
  CDS Start-End: 176-376
caaccgtcccccaacaacccccagccttgtactgatgtcggatgcgagagcctgtgcttaagtaagaatcaggccttattggagacattcaagcaaaggttggacaactacttttccagaacagaaaggaaactcatgcatcagaaaaggtgactaataaaggtaccagaagaatatggctgcacaaataccagaatctgatcagataaaacagtttaaggaatttctggggacctacaataaacttacagagacctgctttttggactgtgttaaagacttcacaacaagagaagtaaaacctgaagaggaatatcatattcagcagaatgaagccctggcagccaaagcaggactccttggccaaccacgatagagaagtcctgatggatgaacttttgatgaaagattgccaacagctgctttattggaaatgaggactcatctgatagaatcccctgaaagcagtagccaccatgttcaaccatctgtcatgactgtttggcaaatggaaaccgctggagaaacaaaattgctatttaccaggaataatcacaatagaaggtcttattgttcagtgaaataataagatgcaacatttgttgaggccttatgattcagcagcttggtcacttgattagaaaaataaaccattgtttcttcaattgtgactgttaattttaaagcaacttatgtgttcgatcatgtatgagatagaaaaatttttattactcaaagtaaaataa

SEQ ID NO: 192960 - DNA, 1271 bp, Homo sapiens
  Payload ID: 18092
  Gene Name: translocase of inner mitochondrial membrane domain containing 1
  ENST ID: ENST00000264244
  CDS Start-End: 183-710
atttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaa

SEQ ID NO: 192961 - DNA, 551 bp, Homo sapiens
  Payload ID: 18092
  Gene Name: translocase of inner mitochondrial membrane domain containing 1
  ENST ID: ENST00000486418
  CDS Start-End: 168-383
aaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagactgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtg

SEQ ID NO: 192962 - DNA, 670 bp, Homo sapiens
  Payload ID: 18092
  Gene Name: translocase of inner mitochondrial membrane domain containing 1
  ENST ID: ENST00000463927
  CDS Start-End: 152-349
ctgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagagtaaaagtgcctaggtgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccc

SEQ ID NO: 192963 - DNA, 2394 bp, Homo sapiens
  Payload ID: 18092
  Gene Name: translocase of inner mitochondrial membrane domain containing 1
  Uniprot ID: Q9NPL8
  ENST ID: ENST00000494664
  CDS Start-End: 203-1060
ggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaagtagatcagcattattaaagaaacggttcaactttgtttcttcccttagtattgctgacaaagtatctgctgtagaatacaggaattacttagaatagaaacatagtcatcacaactgttactaaatggaaaagaaaagaattattgagttaagtattcctgtcaatacgggaaacactgctagtaccttatgttggtgttagacctctctgccctacactgagaatatagttttacacaggagcaaggtttgtgaagcagcatagtgaggtagctaaagccatgggctggctctaaaggctttaaatcccagccatgtggcttagctgccatgagatgtgcatttgagaaatgttgtcttcttttgctgttcaactccagattttcagatgataatgtgattatcccagcttaagttgcgtccacttctggtctagtgaattgtggaaggcagttttagagaaaggagtcatgagtaacatgaacagcagttggctatgtctttccagttctctgctgatgtcagaaagacccagaaataccaaggagaaaaagccatcttagggatctaaggaggccctatggaaagttactaccttagacatttgaagatagcttactgcttagtacatacactgtaaacaacgatctcattttaaatgagaactttctcataaatattttacaaatgaggtcaaactagcataaagccatttaaagagattatcagtccaatatgaaccagttaagtctttggactatccctttcctccttgactactgctttgacgtacctaaatcattcgtct

SEQ ID NO: 192964 - DNA, 725 bp, Homo sapiens
  Payload ID: 18092
  Gene Name: translocase of inner mitochondrial membrane domain containing 1
  ENST ID: ENST00000492164
  CDS Start-End: 160-432
gccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagacaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgag

SEQ ID NO: 192965 - DNA, 710 bp, Homo sapiens
  Payload ID: 18092
  Gene Name: translocase of inner mitochondrial membrane domain containing 1
  ENST ID: ENST00000493694
  CDS Start-End: 188-643
gtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagacactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacag

SEQ ID NO: 192966 - DNA, 605 bp, Homo sapiens
  Payload ID: 18092
  Gene Name: translocase of inner mitochondrial membrane domain containing 1
  ENST ID: ENST00000466984
  CDS Start-End: 154-605
gactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtg

SEQ ID NO: 192967 - DNA, 684 bp, Homo sapiens
  Payload ID: 18092
  Gene Name: translocase of inner mitochondrial membrane domain containing 1
  ENST ID: ENST00000498399
  CDS Start-End: 1-115
gactgccgattcggaagtccttgaggagcgtcagaagcggcttccctacgtcccagagccctattacccggaatctggatgggaccgcctccgggagctgtttggcaaagagtaaaacactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaaga

SEQ ID NO: 192968 - DNA, 3387 bp, Homo sapiens
  Payload ID: 18093
  Gene Name: translocase of outer mitochondrial membrane 20 homolog (yeast)
  Uniprot ID: Q15388
  ENST ID: ENST00000366607
  CDS Start-End: 222-659
gcaggcgcaggagccgcgctctgggcctctgctcaggctctgccgcggacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaactttg

SEQ ID NO: 192969 - DNA, 620 bp, Homo sapiens
  Payload ID: 18094
  Gene Name: translocase of outer mitochondrial membrane 20 homolog (yeast)-like
  Uniprot ID: Q6UXN7
  ENST ID: ENST00000360945
  CDS Start-End: 43-501
ggcccgcgcccaacgctcggcttgtgggacgcccgcggtcggatgccctccgtccgctccctcctccgcctcttggccgccgcggcggcctgtggcgccttcgccttcctgggctattgtatttacctcaaccggaagcggcgcggggaccccgcgttcaagcgccgcctgcgggacaaaagaagagcagagcctcaaaaggctgaggagcagggcacgcagttgtgggatccaacgaagaataaaaagttgcaagaacttttcttgcaagaggtacggatgggagaactttggttatctagaggagagcacagaatggggattcaacacctcggcaatgcccttttagtgtgcgagcaaccacgggaacttctgaaagttttcaaacacactctccctcccaaggtatttgagatgctgttgcacaaaattccccttatttgccagcaatttgaggcagacatgaatgaacaggactgcttggaggatgatcctgattgaaaaacatttcaacgtatccacagtccagtgagaatactatggtaccatacagtataaacaactgctcagtgatatttccatttattttactttgagtaataaaaatttttctatctcat

SEQ ID NO: 192970 - DNA, 438 bp, Homo sapiens
  Payload ID: 18094
  Gene Name: translocase of outer mitochondrial membrane 20 homolog (yeast)-like
  ENST ID: ENST00000557754
  CDS Start-End: 31-255
acgctcggcttgtgggacgcccgcggtcggatgccctccgtccgctccctcctccgcctcttggccgccgcggcggcctgtggcgccttcgccttcctgggctattgtatttacctcaaccggaagcggcgcggggaccccgcgttcaagcgccgcctgcgggacaaaagaagagcagagcctcaaaaggctgaggagcagggcacgcaggagagcacagaatggggattcaacacctcggcaatgcccttttagtgtgcgagcaaccacgggaacttctgaaagttttcaaacacactctccctcccaaggtatttgagatgctgttgcacaaaattccccttatttgccagcaatttgaggcagacatgaatgaacaggactgcttggaggatgatcctgattgaaaaacatttcaacgtatccacagtccagtga

SEQ ID NO: 192971 - DNA, 2040 bp, Homo sapiens
  Payload ID: 18095
  Gene Name: translocase of outer mitochondrial membrane 22 homolog (yeast)
  Uniprot ID: Q9NS69
  ENST ID: ENST00000216034
  CDS Start-End: 32-460
ctcctttccgcttccggtgtcccctacagtcatggctgccgccgtcgctgctgccggtgcaggggaaccccagtccccggacgaattgctcccgaaaggcgacgcggagaagcctgaggaggagctggaggaggacgacgatgaggagctagatgagaccctgtcggagagactatggggcctgacggagatgtttccggagagggtccggtccgcggccggagccacttttgatctttccctctttgtggctcagaaaatgtacaggttttccagggcagccttgtggattgggaccacttcctttatgatcctggttcttcccgttgtctttgagacggagaagttgcaaatggagcaacagcagcaactgcagcagcggcagatacttctaggacctaacacagggctctcaggaggaatgccaggggctctaccctcacttcctggaaagatctagattgttattgctgtttgagctgtctcagtgggataagtttgaaattcaagtgtttgaactgctgataatttggatttttttttttttttaactttggcacattgatctatctaaacctggtggggagaattatccccacattgtctcatggaaagactcaacttgcaactgtgccctccacactatccttacttctgtctccactctgataccagagtgcagccatgcagatggttattccagctctggtcacccgactcctttcaccaaattgctcctaactggaagatctcactttccccttgtggggtaggaaccgatgccagtgggagggatgtgcccctgaccattaacgactgttttttttttttttttttaaagaatggagttgttggggcaggacatgcacacaatgtgaaacagacaaaatgcattacacctgtagtgtaaagtggccactatgaatccctatgtatgagaggagggaggcaggctgcagcttcagccacagaatggggactatggaagacagcaggagctcatttcctctgcacattttggctgttagacctgtgtgtgtgtttaaaaaaagagaagtcagtgctcactttttgtatttaaatattaaaaatgattccaactgaaagtgtcatcctaagtaccttgaaatgagaccacgtcagagacatgtactgcccctcacattttctcacctaaaccagcagcacctccatcttaacagccataggcccaaattgtttccaagtgaaaattcatttttagccaagtacttcatagcaatctttgccctgaatttaggcagtcactttgagatccatcagcctaaaacaaaggattgggtctatgtacttctttagtctataatgacactgtgtaattataaagtatttgtagggaataacatagtactgatttctggggaataggggagggggacagaatttttttttttttttttttgcctgagatcaggtctcactggagtacagtggtgtcgtttgggttcactgcaacctcttacctcccctccaacttggcctcctgggtagctaagactacaggtacacgccaccgtgcccagctagtttcttttatttttggtagagtcagggtttcgccttgttgccccagatagtcttgaactcctgagttctagccatccacccgcctctggcccctcaaagtgctgggattataggcgtcacccaccacgcccagccagagtaagccttttgtgtgtttatcagatcaaccaacactacaatctaggtggtactgttcccattttacagaagaggaaacagccacagaaaggtaattgctcaaggctgcagagttaagtgctagacctggattcaaatccaggcagtccagctacagaacactgctgctgtgcgctcgggatggtggggctgggcccaggcccgctgggtatacatgatctttcacttgttaactagggaaaaacactagtcaccagtgtggtacaaacttgtacttaggtggattcttcaaattgtcaagattagtttttataaattaaaatagactgaaaaatg

SEQ ID NO: 192972 - DNA, 2062 bp, Homo sapiens
  Payload ID: 18096
  Gene Name: translocase of outer mitochondrial membrane 34
  Uniprot ID: Q15785
  ENST ID: ENST00000372813
  CDS Start-End: 154-1083
gctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcaatatctgctgtgctttcatttatgccttttcagctttgcacctggaactctgtagtaataataaaagttattgcttattgggcattca

SEQ ID NO: 192973 - DNA, 1707 bp, Homo sapiens
  Payload ID: 18097
  Gene Name: translocase of outer mitochondrial membrane 40 homolog (yeast)
  Uniprot ID: O96008
  ENST ID: ENST00000252487
  CDS Start-End: 102-1187
ggggcgacggtggtggcggcggcggcagcgggttcggttgcgcgtggcgcacggggtgggagcggagcccaggccgggagcaggcgccgccgccagcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaacga

SEQ ID NO: 192974 - DNA, 1709 bp, Homo sapiens
  Payload ID: 18097
  Gene Name: translocase of outer mitochondrial membrane 40 homolog (yeast)
  Uniprot ID: O96008
  ENST ID: ENST00000405636
  CDS Start-End: 105-1190
ggggcgacggtggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaacg

SEQ ID NO: 192975 - DNA, 1725 bp, Homo sapiens
  Payload ID: 18097
  Gene Name: translocase of outer mitochondrial membrane 40 homolog (yeast)
  Uniprot ID: O96008
  ENST ID: ENST00000426677
  CDS Start-End: 181-1266
cggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaac

SEQ ID NO: 192976 - DNA, 731 bp, Homo sapiens
  Payload ID: 18097
  Gene Name: translocase of outer mitochondrial membrane 40 homolog (yeast)
  ENST ID: ENST00000589649
  CDS Start-End: 88-731
ggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcagg

SEQ ID NO: 192977 - DNA, 707 bp, Homo sapiens
  Payload ID: 18097
  Gene Name: translocase of outer mitochondrial membrane 40 homolog (yeast)
  ENST ID: ENST00000592041
  CDS Start-End: 1-506
ctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccagggaacacttgttaaaaggctctgtggatagcaactggatcgtgggtgccacgctggagaagaagctcccacccctgcccctgacactggcccttggggccttcctgaatcaccgcaagaa

SEQ ID NO: 192978 - DNA, 207 bp, Homo sapiens
  Payload ID: 18097
  Gene Name: translocase of outer mitochondrial membrane 40 homolog (yeast)
  ENST ID: ENST00000589253
  CDS Start-End: 98-207
gtgggtaacgaggagcagcgcagggttcgcagaacagattagaattctcccgaggcactctgggaagggccagcacttccggttttagcaggcgaccatggggaacgtgttggctgccagctcgccgcccgcagggccgccaccgccgcctgcgccggccctcgtggggctgccgccacctccgccctcgccgccgggcttcacgct

SEQ ID NO: 192979 - DNA, 3415 bp, Homo sapiens
  Payload ID: 18097
  Gene Name: translocase of outer mitochondrial membrane 40 homolog (yeast)
  Uniprot ID: O96008
  ENST ID: ENST00000592434
  CDS Start-End: 94-1083
ggtggcggcggcggcagcgggttcggttgcgcgtggcgcacggggtgggagcggagcccaggccgggagcaggcgccgccgccacaggcgaccatggggaacgtgttggctgccagctcgccgcccgcagggccgccaccgccgcctgcgccggccctcgtggggctgccgccacctccgccctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgccaccggaagtgcaaggagctgtttcccattcagatggagggtgtcaagctcacagtcaacaaagggttgagtaaccattttcaggtcaaccacacagtagccctcagcacaatcggggagtccaactaccacttcggggtcacatatgtggggacaaagcagctgagtcccacagaggcgttccctgtactggtgggtgacatggacaacagtggcagtctcaacgctcaggtcattcaccagctgggccccggtctcaggtccaagatggccatccagacccagcagtcgaagtttgtgaactggcaggtggacggggagtatcggggctctgacttcacagcagccgtcaccctggggaacccagacgtcctcgtgggttcaggaatcctcgtagcccactacctccagagcatcacgccttgcctggccctgggtggagagctggtctaccaccggcggcctggagaggagggcactgtcatgtctctagctgggaaatacacattgaacaactggttggcaacggtaacgttgggccaggcgggcatgcacgcaacatactaccacaaagccagtgaccagctgcaggtgggtgtggagtttgaggccagcacaaggatgcaggacaccagcgtctccttcgggtaccagctggacctgcccaaggccaacctcctcttcaaaggtaaaggtctcggttcccctacgcgggaaacaggcaggaggtgactcaactctgagtggatgtgtgggccaccacaggtgctggaggacagtgtgctgccaccctgtgggcctccacattaccagggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggtgacagagcaagactccatctcaaaaaaaaaaaagtaggtggacaaccctctactatgttttatgcttggaaaaaaaaagtaggtagagcagccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatgggtgtttgggccaagctggagctttgtccatcccctcttatttttctgcacttgactctcttatttttctgagactggtctccctctgtcgcccaggctagagtgcagcagtgcaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagattttgggtgtttgagcctcctgctgagcactgctggggccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggagcagtgtggttaaaggtctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgcaagaacaagtttcagtgtggctttggcctcaccatcggctgagccctcctggcccccgccttccacgcccttccgattccacctccacctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccggaattgaggggcacgcaggattctgagcaccaggggcagaggcggccagacaacctcagggaggagtgtcctggcgtccccatcctccaaagggcctgggcccgccccgagggggcagcgagaggagcttccccatccccggtcagtccaccctgccccgtccactttcccatctcctcggtataaatcatgtttataagttatggaagaaccgggacattttacagaaaaaaaacaaaaaacaacaaaaaatatacgtgggaaaaaaaa

SEQ ID NO: 192980 - DNA, 2636 bp, Homo sapiens
  Payload ID: 18098
  Gene Name: translocase of outer mitochondrial membrane 40 homolog (yeast)-like
  Uniprot ID: Q969M1
  ENST ID: ENST00000367987
  CDS Start-End: 187-1113
ctagggttgtctctccatgagtgctctccttccctactcttcctgttccaggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatgaaa

SEQ ID NO: 192981 - DNA, 2708 bp, Homo sapiens
  Payload ID: 18098
  Gene Name: translocase of outer mitochondrial membrane 40 homolog (yeast)-like
  Uniprot ID: Q969M1
  ENST ID: ENST00000367988
  CDS Start-End: 270-1196
ttcaaagatggcgcttacggccacgctaagaatgcagcgtgaagctgcagttctgccatcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaa

SEQ ID NO: 192982 - DNA, 2807 bp, Homo sapiens
  Payload ID: 18098
  Gene Name: translocase of outer mitochondrial membrane 40 homolog (yeast)-like
  Uniprot ID: Q969M1
  ENST ID: ENST00000545897
  CDS Start-End: 334-1158
tttcattgattgggcggggcccaatcagggttgggttgggtctttgacagctttctttgccagattcaaagatggcgcttacggccacgctaagaatgcagcgtgaagctgcagttctgccatcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatgaaacagcagtatccaaatacagcaatttggatgctgaaacgatgtgagacagggatggccagggggaaggactagaccccacgatacctgaattccctaaggaaaggacagtaaaaaaacattcctccc

SEQ ID NO: 192983 - DNA, 751 bp, Homo sapiens
  Payload ID: 18099
  Gene Name: translocase of outer mitochondrial membrane 5 homolog (yeast)
  Uniprot ID: Q8N4H5
  ENST ID: ENST00000321301
  CDS Start-End: 111-266
ggcaacgagagggcgggaacaggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 192984 - DNA, 808 bp, Homo sapiens
  Payload ID: 18099
  Gene Name: translocase of outer mitochondrial membrane 5 homolog (yeast)
  Uniprot ID: Q8N4H5
  ENST ID: ENST00000377773
  CDS Start-End: 66-323
gggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacgctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 192985 - DNA, 789 bp, Homo sapiens
  Payload ID: 18099
  Gene Name: translocase of outer mitochondrial membrane 5 homolog (yeast)
  ENST ID: ENST00000401811
  CDS Start-End: 73-369
gagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacggtagcggggagcaaggaggctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacagg

SEQ ID NO: 192986 - DNA, 635 bp, Homo sapiens
  Payload ID: 18099
  Gene Name: translocase of outer mitochondrial membrane 5 homolog (yeast)
  Uniprot ID: Q8N4H5
  ENST ID: ENST00000544379
  CDS Start-End: 65-343
ggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacggtagcggggagcaaggagggtgcgcgttgaaggcgacgggcatatgcgcggtttgagctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggta

SEQ ID NO: 192987 - DNA, 3071 bp, Homo sapiens
  Payload ID: 18099
  Gene Name: translocase of outer mitochondrial membrane 5 homolog (yeast)
  ENST ID: ENST00000540941
  CDS Start-End: 1-216
gaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacggtagcggggagcaaggagggtgcgcgttgaaggcgacgggcatatgcgcggtttgagctccatttatcttaaagaaattggacagcatatgaagacaggacatcacatatgaatgcacgatatgaagagcctggttacagtttcgactcctctctgcaagtgaataggcccagaaagttatttcccattgagctggtcattgctcagagaacaaagactcttccaatctcccaagtgctgaatgaggccctgccaacgttctgggattcaaaggaatagggctgtggtgaggctcaggacagacaggtttatatcttaaaacaaaaacctttaccgtcatttaatgggatttttgggagggagtggaggtaggtatacgtgcttcatctaccatcttaacctggaaagcatgtattttaattctgtggttttgtatttatttcttaaattaagaaggtgtagtgtatggcactgtggtcatatgaatactggctctaaagacaggcagacttgattttgaatgttggctccaatacttacgagatgggtgattttcagcaagtgagctccgaatctcattttctttaactataaaattaggataatagaaacatctctctacttcaaagtgtcgtaaggattaagtgaaaaaatgcaagtagagcagctggcacaattgcttgacatttggtaaatgttattaatggctagtctttggtataaggcatttagaagtgatttgtgctggcattcacagcatagacagatctcattcctatttccagatgctctgagatagcatactcatcctctaattgtgtacaaacttcaaacttaccaaacacttaagttcattatctaaaaatagccttaaccaatcaataataatgccattttacaggtggagaggttgagactgcaagtttcagtggccaatgagtagcagctggccaaggcctaggggactttttttttttttttcatttaaaaaaattatttctagtcagtctgtgcttatccaggggacttttaatgtttatttattccttgtaccccatccttacatgcttttcttggaggaaaatagtgtaattgttaccctggattctagtgtatgttcaggctggagtaagagaaaatgtgatggttcagtttttgtgaccagctttttaactttcaggccataaacgccacagaggggctcaatacttggaataagcagttctaaaatagtacattaagaaacagttggggagatatatacagtttgtttgtttgaatatgtaacatgaaataagaaagaaccatagcaaatttgagtttggtaaactcttgaaaggggtacgttgaaagaaatggggatagtgaaaaatgtttattctccacaaacaggttaccagcttagtaggaatgctgctcctaagttaaggtagtgtacttcctgctgtcagtgcaacattaaaaaaaaaaactgctttatcattgctctttatagttcttctgtggagtaagttagcattacagttaacatgttcagcagttcacaggctggaaaatttgggcctacatttggaatgaagaacaagtacaggaatcaggacttcttgttctcttccccctctttgcttgagctaagcttgtctcttacaagatccaggcaccattctttttactctattttgcttttatagcttgatcatgtcataaattctgcatgtagctcagtcgtcaagccactaaagcaggggttggcaagctttctgttaggggcaaatggtaaatattttaggctttgtgggctcttacgatctctcagctgccaactgcagttggtagtatgaaagcagccagggacaatatgcaaatgagtgggtgtggctgtgtcccaataaaactttatttacagaaaagatggctggccggatttgtcctacaggacaccttctaaagtaaagagtaaaatttggctaagtgtgaaatggtcaccaaatcacttttattactttaaagatgttcattttatcatagatcaaagccctgagattacaaattcattcatcagcgttactgagttcctgctatgtgccaggcactgtgctaggagttgaggatatggacgggcagggggactgcctttttgaggtctataatctgccataagatgccatgtgagtaaatatctcaaagacctgaaaaccttgctggaggctcagagagaacttacctgaaaacatgacatttaaaggaacctgaagggataggtccaggttatctagggtgactaggtaaagggagggtcaggcaaagatcatgttgatcaaggtggggagttcagaattgtccacttaaaacaatattggatgcaatatgggtactgtatttgaaggagaggtcagaggggtatatgagcagctcagcatttatttagatacgtgtagtgaggaaagaaaggcatcaaagaagactccctgatttctggtttaagtgcagggttgacggtgccattcgctgaagtaaggaacaagtttcaaggggaaaataatgggttcgattttgagcctgggaggcagtagggaggactcccttaggaagagacacataaagtaaggtttgggtgaataggaattggccagatagagcggggcatctttgaaaaagtgttaaagcagatgtatttgaggaagaaagaccagtgtgactgaagtgtgttgtgcacagaagagcaagaaagcctcagtccttccagaaactcctgttatttattgtgttttcatacttgagtcttaagagattccattctgacatctgctggctattgtgtatactgcagttccaaattccactacacaagaacaacctttaataacgtattttttgaaatttgtcataataaatttgagataaaacacaa

SEQ ID NO: 192988 - DNA, 595 bp, Homo sapiens
  Payload ID: 18100
  Gene Name: translocase of outer mitochondrial membrane 6 homolog (yeast)
  Uniprot ID: Q96B49
  ENST ID: ENST00000398881
  CDS Start-End: 34-258
tcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcag

SEQ ID NO: 192989 - DNA, 637 bp, Homo sapiens
  Payload ID: 18100
  Gene Name: translocase of outer mitochondrial membrane 6 homolog (yeast)
  Uniprot ID: Q96B49
  ENST ID: ENST00000398884
  CDS Start-End: 37-261
ggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtc

SEQ ID NO: 192990 - DNA, 778 bp, Homo sapiens
  Payload ID: 18101
  Gene Name: translocase of outer mitochondrial membrane 7 homolog (yeast)
  Uniprot ID: Q9P0U1
  ENST ID: ENST00000358435
  CDS Start-End: 73-240
ctcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgttatgcttgagtcttttttgaattgaacatgctaggattatcaggtaaaaattaagccttttggtactttctcaaaacagggaatttatgtgtgtacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaagaaa

SEQ ID NO: 192991 - DNA, 514 bp, Homo sapiens
  Payload ID: 18101
  Gene Name: translocase of outer mitochondrial membrane 7 homolog (yeast)
  ENST ID: ENST00000372879
  CDS Start-End: 13-390
acggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagggtgtggtggctcacacctgtaatctcagcactttggaaagccaaggtgggaagatcatgggaggattgcttgaagctaggagttcaagaccagcctgggcaacgtagcgagacccatctctaccaaaaaaaaaaaacctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgt

SEQ ID NO: 192992 - DNA, 455 bp, Homo sapiens
  Payload ID: 18101
  Gene Name: translocase of outer mitochondrial membrane 7 homolog (yeast)
  ENST ID: ENST00000405021
  CDS Start-End: 101-256
tctcggggtgtttttcctcaccgctccatgtggtcctaagtggaaagagtcctgttcagggaatcgagacacctcgtgaaagtaccactgccatgaaagcatgattataataatagtcgttggatgcctctgctttcttacctgtacgatgaagggtttggatgatttctattactgcccccattttacaggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgtta

SEQ ID NO: 192993 - DNA, 241 bp, Homo sapiens
  Payload ID: 18101
  Gene Name: translocase of outer mitochondrial membrane 7 homolog (yeast)
  ENST ID: ENST00000621567
  CDS Start-End: 74-241
cctcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagattgtcatgggattaa

SEQ ID NO: 192994 - DNA, 4409 bp, Homo sapiens
  Payload ID: 18102
  Gene Name: translocase of outer mitochondrial membrane 70 homolog A (S. cerevisiae)
  Uniprot ID: O94826
  ENST ID: ENST00000284320
  CDS Start-End: 450-2276
cttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaagctcttctatctattctttaaatagaaagata

SEQ ID NO: 192995 - DNA, 9708 bp, Homo sapiens
  Payload ID: 18103
  Gene Name: translocated promoter region, nuclear basket protein
  Uniprot ID: P12270
  ENST ID: ENST00000367478
  CDS Start-End: 298-7389
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttatgaaatgctgcaagataatgttgaaggatatcgtcgagaaataacatcacttcatgagagaaatcagaaactcactgccacaactcaaaagcaagaacagattatcaatacgatgactcaagatttgagaggagcaaatgagaagctagctgtcgcagaagtaagagcagaaaatttgaagaaggaaaaggaaatgcttaaattgtctgaagttcgtctttctcagcaaagagagtctttgttagctgaacaaagggggcaaaacttactgctaactaatctgcaaacaattcagggaatactggagcgatctgaaacagaaaccaaacaaaggcttagtagccagatagaaaaactggaacatgagatctctcatctaaagaagaagttggaaaatgaggtggaacaaaggcatacacttactagaaatctagatgttcaacttttagatacaaagagacaactggatacagagacaaatcttcatcttaacacaaaagaactattaaaaaatgctcaaaaagaaattgccacattgaaacagcacctcagtaatatggaagtccaagttgcttctcagtcttcacagagaactggtaaaggtcagcctagcaacaaagaagatgtggatgatcttgtgagtcagctaagacagacagaagagcaggtgaatgacttaaaggagagactcaaaacaagtacgagcaatgtggaacaatatcaagcaatggttactagtttagaagaatccctgaacaaggaaaaacaggtgacagaagaagtgcgtaagaatattgaagttcgtttaaaagagtcagctgaatttcagacacagttggaaaagaagttgatggaagtagagaaggaaaaacaagaacttcaggatgataaaagaagagccatagagagcatggaacaacagttatctgaattgaagaaaacactttctagtgttcagaatgaagtacaagaagctcttcagagagcaagcacagctttaagtaatgagcagcaagccagacgtgactgtcaggaacaagctaaaatagctgtggaagctcagaataagtatgagagagaattgatgctgcatgctgctgatgttgaagctctacaagctgcgaaggagcaggtttcaaaaatggcatcagtccgtcagcatttggaagaaacaacacagaaagcagaatcacagttgttggagtgtaaagcatcttgggaggaaagagagagaatgttaaaggatgaagtttccaaatgtgtatgtcgctgtgaagatctggagaaacaaaacagattacttcatgatcagatcgaaaaattaagtgacaaggtcgttgcctctgtgaaggaaggtgtacaaggtccactgaatgtatctctcagtgaagaaggaaaatctcaagaacaaattttggaaattctcagatttatacgacgagaaaaagaaattgctgaaactaggtttgaggtggctcaggttgagagtctgcgttatcgacaaagggttgaacttttagaaagagagctgcaggaactgcaagatagtctaaatgctgaaagggagaaagtccaggtaactgcaaaaacaatggctcagcatgaagaactgatgaagaaaactgaaacaatgaatgtagttatggagaccaataaaatgctaagagaagagaaggagagactagaacaggatctacagcaaatgcaagcaaaggtgaggaaactggagttagatattttacccttacaagaagcaaatgctgagctgagtgagaaaagcggtatgttgcaggcagagaagaagctcttagaagaggatgtcaaacgttggaaagcacgtaaccagcatctagtaagtcaacagaaagatccagatacagaagaatatcggaagctcctttctgaaaaggaagttcatactaagcgtattcaacaattgacagaagaaattggtagacttaaagctgaaattgcaagatcaaatgcatctttgactaacaaccagaacttaattcagagtctgaaggaagatctaaataaagtaagaactgaaaaggaaaccatccagaaggacttagatgccaaaataattgatatccaagaaaaagtcaaaactattactcaagttaagaaaattggacgtaggtacaagactcaatatgaagaacttaaagcacaacaggataaggttatggagacatcggctcagtcctctggagaccatcaggagcagcatgtttcagtccaggaaatgcaggaactcaaagaaacgctcaaccaagctgaaacaaaatcaaaatcacttgaaagtcaagtagagaatctgcagaagacattatctgaaaaagagacagaagcaagaaatctccaggaacagactgtgcaacttcagtctgaactttcacgacttcgtcaggatcttcaagatagaaccacacaggaggagcagctccgacaacagataactgaaaaggaagaaaaaaccagaaaggctattgtagcagcaaagtcaaaaattgcacacttagctggtgtaaaagatcagctaactaaagaaaatgaggagcttaaacaaaggaatggagccttagatcagcagaaagatgaattggatgttcgcattactgcgctaaagtcccaatatgaaggtcgaattagtcgcttggaaagagaactcagggagcatcaagagagacaccttgagcagagagatgagcctcaagaaccttctaataaggtccctgaacagcagagacagatcacattgaaaacaactccagcttctggtgaaagaggaattgccagcacatcagacccaccaacagccaatatcaagccaactcctgttgtgtctactccaagtaaagtgacagctgcagctatggctggaaataagtcaacacccagggctagtatccgcccaatggttacacctgcaactgttacaaatcccactactaccccaacagctacagtgatgcccactacacaagtggaatcacaggaagctatgcagtcagaagggcctgtggaacatgttccagtttttggaagcacaagtggatccgttcgttctactagtcctaatgtccagccttctatctctcaacctattttaactgttcagcaacaaacacaggctacagcttttgtgcaacccactcaacagagtcatcctcagattgagcctgccaatcaagagttatcttcaaacatagtagaggttgttcagagttcaccagttgagcggccttctacttccacagcagtatttggcacagtttcggctacccccagttcttctttgccaaagcgtacacgtgaagaggaagaggatagcaccatagaagcatcagaccaagtctctgatgatacagtggaaatgcctcttccaaagaagttgaaaagtgtcacacctgtaggaactgaggaagaagttatggcagaagaaagtactgatggagaggtagagactcaggtatacaaccaggattctcaagattccattggagaaggagttacccagggagattatacacctatggaagacagtgaagaaacctctcagtctctacaaatagatcttgggccacttcaatcagatcagcagacgacaacttcatcccaggatggtcaaggcaaaggagatgatgtcattgtaattgacagtgatgatgaagaagaggatgatgatgaaaatgatggagaacatgaggattatgaagaggatgaggaagatgatgatgatgatgaagatgacacagggatgggagatgagggtgaagatagtaatgaaggaactggtagtgccgatggcaatgatggttatgaagctgatgatgctgagggtggtgatgggactgatccaggtacagaaacagaagaaagtatgggtggaggtgaaggtaatcacagagctgctgattctcaaaacagtggtgaaggaaatacaggtgctgcagaatcttctttttctcaggaggtttctagagaacaacagccatcatcagcatctgaaagacaggcccctcgagcacctcagtcaccgagacgcccaccacatccacttcccccaagactgaccattcatgccccacctcaggagttgggaccaccagttcagagaattcagatgacccgaaggcagtctgtaggacgtggccttcagttgactccaggaataggtggcatgcaacagcatttttttgatgatgaagacagaacagttccaagtactccaactcttgtggtgccacatcgtactgatggatttgctgaagcaattcattcgccgcaggttgctggtgtccctagattccggtttgggccacctgaagatatgccacaaacaagttctagtcactctgatcttggccagcttgcttctcaaggaggtttaggaatgtatgaaacacccctgttcctagctcatgaagaagagtcaggtggccgaagtgttcccactactccactacaagtagcagccccagtgactgtatttactgagagcaccacctctgatgcttcggaacatgcctctcaatctgttccaatggtgactacatccactggcactttatctacaacaaatgaaacagcaacaggtgatgatggagatgaagtatttgtggaggcagaatctgaaggtattagttcagaagcaggcctagaaattgatagccagcaggaagaagagccggttcaagcatctgatgagtcagatctcccctccaccagccaggatcctccttctagctcatctgtagatactagtagtagtcaaccaaagcctttcagacgagtaagacttcagacaacattgagacaaggtgtccgtggtcgtcagtttaacagacagagaggtgtgagccatgcaatgggagggagaggaggaataaacagaggaaatattaattaaatggtctgtaaacaataacaactgtgaataagattatcaaatctgttttagtgtaatgattgtcaagtttaaaaacatttttatatataaactggtatactcatgtcaatattctttattaataaaatgtttttcagtgtcaaaatttattattcatttcttcattagttgactcctcctttgctcatcagtctaaggacagttgtaccagactttggataaggtctgcccagaacgagtagtaattgctcttgctgttctactaggcacatcaatgttatagtattgatctaaatggaagagaaaacatttttttagttaaaaagaaaacaatgcccaaactaaaaaataacttatgttgactattatgctcaaagacaatgtttatcattttaatagagatgtttttactaattaatttgaactttataacaaaaagaaaaacaattgcctagacttttcagcttttttgatgtttcaaaagattgacatttcaccatctttttgtaaaatcaggttcagctctcctttatgaagtaaacattaaagagtaaccaagtttgaaaaataatttacttggggttattccttttaaaaaatacatgccaatgtcattcatattatgaaattacaggcagaataacttagatttctgggcatttcaaagaaaagcatcctgagtaatataatttaattaataaaattagtttctcaggaacttctttctgatcttacagactctgcagtgatgcaaatcattataaccttgtgccaaacaaggtatctgttaaatgccacaaatgatagaagtaaaatactattgtcagtagcaagtttactctagtaactggatgttttatcgtaatctcatgaaggttagagcagaattgaattgcagtgccatcattttaattgaaattaaagcaaaagtcttaactcttttccacagcaattagaataagtaccgtagtgtaacttctcacattcagtcatcattgcagccagcatttttactttatcttcatgttttcacaaatgatatcacctccttgggaaactgttagttaataccttacctttagaaaaggcatagtaatcatagccgtcaggttttctgatgttgggcagtgatatagctgaggtaaccacatttggaagtcctctccacagtatactcactttaacttcattatgaaggacacctgtaagtggcatgtttaataaaagataccagattaaaaggcaatgtactatcttggaaagagccagacatctgagttttaatctcagttttagccctctgatgtagaactattgagggttatagactggtatataatgttcttggtaagaagtacttgataaatagtattggttataactaacaaacctgaacaaactgctttacttacccacaaggaaaaagaaagtattggtctttggttattcactaaggcaagtggatgagtttttcatcagtaagcttaaattattagggctgtttgatcagtatccatatttcataagccttactgtataagaaactgtattacatctacttatgtttaaggatttttttaacacaataaaaatgttacctttgtcttgataagccagtctggcaggtgaatattgaattctgatggtgtgtgtttgagaaggtcctatagcacgttcaaagcgacgtctcctaacctgtgtcgtttctccatacactggataatttagagcaggccttcttccagggcacttctgtacaggttcctgtttataaatatactgctgaatgctgccacctgttatgtattagaatatcacatggaaaatgaaaattaattttaataccctcagaaaaggtggaaaacaacttttacaatgtataggaaacagttttgttctcatttttcatataatatattgatattaataatggctattagtcaagggtattataaaaataattattaaactgaaatacttgttgaatgaatagatgcagcaaattacatagttatatatttaatttcaattgaaagtgacaagtgctcagtttggcagcacatatactaaaactggaatgatacagagattagcatggcccttgtgcaaggatgacatgcacatttgtgaagcgaaagtaaatgacattctatcagtgacctgaaaactcaaatgaattgtgacttgcctgtgaagaaatgaaaataaaaattgagggcaataagaatactaccctcaatattgatttttttcactgaaaatatttgatttcagccattaaagatatcttttgacagtaaagtcaataataaatgaaaa

SEQ ID NO: 192996 - DNA, 515 bp, Homo sapiens
  Payload ID: 18103
  Gene Name: translocated promoter region, nuclear basket protein
  ENST ID: ENST00000451586
  CDS Start-End: 66-515
ccttctgggcgccatagagagcgtggcggtatcccggagcctgccgtccggccctaccgggaccgatgccctctagtggctcagtgtccagaagccgccaacgaggacgatccatggcatcccggggctttgacgggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagag

SEQ ID NO: 192997 - DNA, 2478 bp, Homo sapiens
  Payload ID: 18103
  Gene Name: translocated promoter region, nuclear basket protein
  Uniprot ID: P12270
  ENST ID: ENST00000613151
  CDS Start-End: 298-2478
gcgcaagaggatcagggatagcctctgagctcgggttcccagggttcgtagcttccaacggctgcgcgcgcacttcggtcgcgggcggtgaggtgctgttgctgaaacgctgccgctgagggtggactcgatttcccagggtcccgccgcgggagtctccggcgggcgggcgcgcgcgagccaccgagcgaggtgatagaggcggcggcccaggcgtctgggtcctgctggtcttcgcctttcttctccgcttctaccccgtcggccgctgccactggggtccctggccccaccgacatggcggcggtgttgcagcaagtcctggagcgcacggagctgaacaagctgcccaagtctgtccagaacaaacttgaaaagttccttgctgatcagcaatccgagatcgatggcctgaaggggcggcatgagaaatttaaggtggagagcgaacaacagtattttgaaatagaaaagaggttgtcccacagtcaggagagacttgtgaatgaaacccgagagtgtcaaagcttgcggcttgagctagagaaactcaacaatcaactgaaggcactaactgagaaaaacaaagaacttgaaattgctcaggatcgcaatattgccattcagagccaatttacaagaacaaaggaagaattagaagctgagaaaagagacttaattagaaccaatgagagactatctcaagaacttgaatacttaacagaggatgttaaacgtctgaatgaaaaacttaaagaaagcaatacaacaaagggtgaacttcagttaaaattggatgaacttcaagcttctgatgtttctgttaagtatcgagaaaaacgcttggagcaagaaaaggaattgctacatagtcagaatacatggctgaatacagagttgaaaaccaaaactgatgaacttctggctcttggaagagaaaaagggaatgagattctagagcttaaatgtaatcttgaaaataaaaaagaagaggtttctagactggaagaacaaatgaatggcttaaaaacatcaaatgaacatcttcaaaagcatgtggaggatctgttgaccaaattaaaagaggccaaggaacaacaggccagtatggaagagaaattccacaatgaattaaatgcccacataaaactttctaatttgtacaagagtgccgctgatgactcagaagcaaagagcaatgaactaacccgggcagtagaggaactacacaaacttttgaaagaagctggtgaagccaacaaagcaatacaagatcatcttctagaggtggagcaatccaaagatcaaatggaaaaagaaatgcttgagaaaatagggagattggagaaggaattagagaatgcaaatgaccttctttctgccacaaaacgtaaaggagccatattgtctgaagaagagcttgccgccatgtctcctactgcagcagctgtagctaagatagtgaaacctgggatgaaactaactgagctctataatgcttatgtggaaactcaggatcagttgcttttggagaaactagagaacaaaagaattaataagtacctagatgaaatagtgaaagaagtggaagccaaagcaccaattttgaaacgccagcgtgaggaatatgaacgtgcacagaaagctgtagcaagtttatctgttaagcttgaacaagctatgaaggagattcagcgattgcaggaggacactgataaagccaacaagcaatcatctgtacttgagagagataatcgaagaatggaaatacaagtaaaagatctttcacaacagattagagtgcttttgatggaacttgaagaagcaaggggtaaccacgtaattcgtgatgaggaagtaagctctgctgatataagtagttcatctgaggtaatatcacagcatctagtatcttacagaaatattgaagagcttcaacaacaaaatcaacgtctcttagtggcccttagagagcttggggaaaccagagaaagagaagaacaagaaacaacttcatccaaaatcactgagcttcagctcaaacttgagagtgcccttactgaactagaacaactccgcaaatcacgacagcatcaaatgcagcttgttgattccatagttcgtcagcgtgatatgtaccgtattttattgtcacaaacaacaggagttgccattccattacatgcttcaagcttagatgatgtttctcttgcatcaactccaaaacgtccaagtacatcacagactgtttccactcctgctccagtacctgttattgaatcaacagaggctatagaggctaaggctgcccttaaacagttgcaggaaatttttgagaactacaaaaaagaaaaagcagaaaatgaaaaaatacaaaatgagcagcttgagaaacttcaagaacaagttacagatttgcgatcacaaaataccaaaatttctacccagctagattttgcttctaaacgttacttgtag

SEQ ID NO: 192998 - DNA, 2785 bp, Homo sapiens
  Payload ID: 18104
  Gene Name: translocation associated membrane protein 1
  Uniprot ID: Q15629
  ENST ID: ENST00000262213
  CDS Start-End: 171-1295
cgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaa

SEQ ID NO: 192999 - DNA, 535 bp, Homo sapiens
  Payload ID: 18104
  Gene Name: translocation associated membrane protein 1
  ENST ID: ENST00000518678
  CDS Start-End: 199-535
gtgtttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgtaa

SEQ ID NO: 193000 - DNA, 3394 bp, Homo sapiens
  Payload ID: 18104
  Gene Name: translocation associated membrane protein 1
  ENST ID: ENST00000521425
  CDS Start-End: 1038-1904
cgcagttcctggttcccgcgaagggttacgtggcagccggcgaggggcctgcgggcgggggcggcccctgcgctgccgagctggctcggggcgggtgggcggacttggggggactgccagcctcggccgcggtgagcgtcagccccgcgagggccggggaaggccgaggcccggcccccgggtctgaggagtgccggcctggagaccacaggccccgagtgacaggggagcccccggtagctccgagattggggtgagcgagaaaccggagtcaggcatctgctttcgacttgaagggcggtggccgccgggcaccggcgcagtggaggcgcgccagattgttttcatttttgtcttttaaactgatattattaccagttaacgaactttttgccctgacgctttaaagaaacaaggtctgatggataaatcgaggttctgaacagcggtgccaaggaatcgagtaattttgtttcttgaagtaggagaggatgggaatgtcaggagtgtgtaaattctcttcccacgtatctagtattttgatgacttatttaacagctgttgaatgtggatgataaactttgcaaggtgaacgagtaacatcctacgtttttcccctcgctccccaatacacacgctcattcctttgcttttttccctttttaatttttctctggagcctttatgtctcagtaaatatacaaattattttgctcctgccttgttttgtctcctctctcctgcatgtaacaagtgagagtagagattttggagtatttttacgagtctgtatttccagagtctaggatagtgcctgggacataggagtgcttaaaaaaagatgagcgacgttaagaatccttgagaaaacctaatggaatgatattaccagtgaccaaaagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaa

SEQ ID NO: 193001 - DNA, 2023 bp, Homo sapiens
  Payload ID: 18105
  Gene Name: translocation associated membrane protein 1-like 1
  Uniprot ID: Q8N609
  ENST ID: ENST00000310754
  CDS Start-End: 184-1293
atgctcagctcagctcggccctcgcctttgatttattttttttctgggcggccgctgcgacccgggactgacttcgggatgggaagtggagcccccggagctgctaccgtggcggcggcgctgtgaggagcagccagggggaggcagctgcggctcgccggtgagtatccgggaagcgccaccatggggctccgtaagaagagcaccaagaacccccccgttctcagccaggaattcatcctgcagaatcatgcggacatcgtctcctgcgtggggatgttcttcctgctggggcttgtgttcgagggaacagcagaagcatccatcgtgtttctcactcttcagcacagtgttgctgtccctgcagcagaggaacaagccacgggctcaaagtccctctattattatggtgtcaaagatttggccacggttttcttctacatgctggtggcaatcattattcatgccacaattcaggaatatgtgttggataaaattaacaagagaatgcagttcaccaaagcgaaacaaaacaagtttaacgagtctggtcagtttagtgtgttctactttttttcttgtatttggggcacattcattttaatctctgaaaactgcctgtcagacccaactcttatatggaaggctcgtccccatagcatgatgacatttcaaatgaagtttttctacatatcccagttggcttactggtttcatgcttttcctgaactctacttccagaaaaccaaaaaacaagacatccctcgtcaacttgtctacattggtcttcacctcttccacattactggagcttatctcttgtacttgaatcatttgggacttcttcttttggtactgcattattttgttgaattactttcccacatgtgcggcctgttttactttagtgatgaaaagtaccagaaaggcatatctctgtgggccattgtgtttatcttgggtagacttgtgactttaattgtttccgtactcactgttgggtttcacctggctggatcgcagaatcggaatcctgatgcccttactggaaatgtaaatgtgttggcagctaaaattgctgttctgtcgtccagttgcacgatccaagcctacgtaacatggaacttaattactctctggcttcagaggtgggtagaagattctaatattcaggcctcatgtatgaaaaagaaacggtcgagatcttctaaaaaaagaacagaaaacggagtgggagtggaaacttcaaatagagtagactgtccgccaaagaggaaagagaaatcttcataatctttgcaagcgcattgattaatgtctgcaaaggaatctgctctttgaggtttctttctgcactagagatttttctgtttttgaaaatagttcgtgctcttcggtttttgttattgaactgtttcatgtattttttaaagacatttgaggggaggaggattattatgaatgggaaaaaaagattttggttgagactaaattactcatcgtcaaaataatgtcaaaatagttttggggatcaccactatattttgttttgatttttaacctttcaacattttcctaatgatttgcagagataactgcacaattttgcatatcaatgatactggttcttactcccaccagtgtttcataatactaacaagatggtctctcctagcaagattatgtgtttaatgcttgctttggggtaaaataaaagtacgaaaaaggtggaagtcaaatcagtattctgtaattgttagaatttattttttaagaacttacaactcagaaaagattgctagactcaccaaaataataaatgttctttattttacaggtagtgattattagtgcttcatccccatttaaaaaaacacagtactaatgggtaacacatatggaggtttgctgccatatatattgcatcaaaatatcattaattaatataaaaatattaaaatcattcctgtccattccacttgtaaatgggaattcatgaaattaaatattactttaaaaagga

SEQ ID NO: 193002 - DNA, 6908 bp, Homo sapiens
  Payload ID: 18106
  Gene Name: translocation associated membrane protein 2
  Uniprot ID: Q15035
  ENST ID: ENST00000182527
  CDS Start-End: 1-1113
atggctttccgcaggaggacgaaaagttacccgctcttcagccaggagttcgtcatccacaaccatgcggacatcggcttctgcctggtgctctgcgtcctcatcgggcttatgttcgaggtcacagccaagactgcctttctatttattttacctcagtataacattagcgtgcctacagcagacagtgagaccgtgcactaccactatggccctaaggacctggtcacaatcttgttctacatcttcatcaccatcatcttgcatgctgtggttcaggagtacattttagataaaatcagcaaacggcttcatctctccaaagtcaaacacagcaagttcaatgaatctggacagctggtcgtctttcatttcacctcggtgatttggtgcttctacgtggtggtgacggaaggatacttaacaaacccaagaagcctctgggaagactacccgcatgtgcacctccccttccaggtgaagtttttctacctatgccagctggcctactggctgcacgcacttcctgagctatacttccagaaggtacggaaggaggaaattccccgccagctccagtatatttgcctgtacctggtgcatatagctggagcatacctcttaaacctgagccgcctgggcctgatcttgctgctgctgcagtactcaactgagttcctcttccacacggctagactcttctactttgcagatgaaaacaacgagaaactgttcagtgcctgggctgctgtttttggggttacccgcctcttcatcctcacccttgccgtgctggccattggctttggactggctcgcatggaaaaccaggcatttgatcccgagaaagggaacttcaacactttgttttgcaggctctgcgtgctgctgctggtgtgtgccgcccaggcctggctcatgtggcgcttcatccactcccagctgcggcactggcgggaatactggaatgagcagagtgcaaagcggagagtcccagccacacccagactaccagccaggctcatcaagagggaatctggttaccatgaaaatggagtggtgaaggcagagaacggaacctccccacggactaagaaactcaagtctccctaaggccaaagtgctaagaacaggaatcctcttggtgggggccgagcagggggcaaggagcccaggccccctccctgcctcctccttcctgcctgtgatgctccgtctcaaacagccgaaacctgtcttgcaatggggggagggggcgtttcgctttccttcttcttggcttcctcttattcttccacaaaccattctcaataaagccaaaaatctttctctttctccccctcaggccacctcctgtcctcactcctgtcctgtgctggcttttctggaacgccaggcgcccatggctggcacctttctgcttgctctgtctcttgccttatggctgctgcttttcctttttacttcctattttcaccttatcttgcaatttttctgtctgatttttacaatgggaggggagctaagattgcagtcctgtccttcggtcccccagggcctgccggtcagaagcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacacgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggcggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttcccccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggccttcgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtagactttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaaactctcctctggccccacatagcaaactccttctccgttattttccccacccccagattttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaaaattatcagaa

SEQ ID NO: 193003 - DNA, 955 bp, Homo sapiens
  Payload ID: 18107
  Gene Name: translocator protein (18kDa)
  Uniprot ID: P30536
  ENST ID: ENST00000329563
  CDS Start-End: 227-736
ccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattt

SEQ ID NO: 193004 - DNA, 881 bp, Homo sapiens
  Payload ID: 18107
  Gene Name: translocator protein (18kDa)
  Uniprot ID: P30536
  ENST ID: ENST00000337554
  CDS Start-End: 121-630
ggcggctgggaggggcggggcggatgcggggacagcggcctggctaactcctgccaggcagtgcccttcccggagcgtgccctcgccgctgagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttta

SEQ ID NO: 193005 - DNA, 1075 bp, Homo sapiens
  Payload ID: 18107
  Gene Name: translocator protein (18kDa)
  Uniprot ID: P30536
  ENST ID: ENST00000396265
  CDS Start-End: 316-825
ctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcaggtgcgttgcagcctagacgggtcttactgtgagccgagcagcctctgggacctgtctgcttcccctaccccttgcaaagaagccggagcccagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttt

SEQ ID NO: 193006 - DNA, 672 bp, Homo sapiens
  Payload ID: 18107
  Gene Name: translocator protein (18kDa)
  ENST ID: ENST00000428336
  CDS Start-End: 352-672
caggaagcgcggtcccaggagtggccgacgctccctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcaggtgcgttgcagcctagacgggtcttactgtgagccgagcagcctctgggacctgtctgcttcccctaccccttgcaaagaagccggagcccagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgg

SEQ ID NO: 193007 - DNA, 636 bp, Homo sapiens
  Payload ID: 18107
  Gene Name: translocator protein (18kDa)
  ENST ID: ENST00000583777
  CDS Start-End: 189-386
agcggcctggctaactcctgccaggcagtgcccttcccggagcgtgccctcgccgctggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttccttt

SEQ ID NO: 193008 - DNA, 718 bp, Homo sapiens
  Payload ID: 18108
  Gene Name: translocator protein 2
  Uniprot ID: Q5TGU0
  ENST ID: ENST00000373158
  CDS Start-End: 229-441
agttctcggtgagggccagctacatacctggctaagcgctgcccactgcagaaaagctcatcacccgggacctgatctccaggactcagaagcacttggaggaaggcctattcacttagaagcagttaccagtgctgggcagtgtcctccaagtgccagaggagtgctgtggagaaaagaagtccatggaagccaggagatgggcaagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtggggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgttt

SEQ ID NO: 193009 - DNA, 958 bp, Homo sapiens
  Payload ID: 18108
  Gene Name: translocator protein 2
  Uniprot ID: Q5TGU0
  ENST ID: ENST00000373161
  CDS Start-End: 246-758
atcagcttaggtagaacagttctcggtgagggccagctacatacctggctaagcgctgcccactgcagaaaagctcatcacccgggacctgatctccaggactcagaagcacttggaggaaggcctattcacttagaagcagttaccagtgctgggcagtgtcctccaagtgccagaggagtgctgtggagaaaagaagtccatggaagccaggagatgggcaagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtgggctatgcctcctacctggtgtggaaggacctgggagggggcttggggtggcccctggccctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgtttttccttagaaatcagagaaatgggaaagggggggaaactgattttacacttaaataataaaatcctattagtaactctgaa

SEQ ID NO: 193010 - DNA, 699 bp, Homo sapiens
  Payload ID: 18108
  Gene Name: translocator protein 2
  Uniprot ID: Q5TGU0
  ENST ID: ENST00000470917
  CDS Start-End: 112-624
tccaagtgccagaggagtgctgtggagaaaagaagtccatggaagccaggagatgggcaaggtgtggcctggggttggagagagctcagagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtgggctatgcctcctacctggtgtggaaggacctgggagggggcttggggtggcccctggccctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttaggg

SEQ ID NO: 193011 - DNA, 1450 bp, Homo sapiens
  Payload ID: 18109
  Gene Name: transmembrane (C-terminal) protease, serine 12
  Uniprot ID: Q86WS5
  ENST ID: ENST00000398458
  CDS Start-End: 33-1079
acctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcagaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcaggggtgacagtgggggaccattaatgtgctacttaccagaatataaaagattttttgtaatgggaattaccagttacggacatggctgtggtcgaagaggttttcctggtgtctatattgggccatccttctaccaaaagtggctgacagagcatttcttccatgcaagcactcaaggcatacttactataaatattttacgtggccagatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatattttatgtgtataaatgccaaataatagtttataattaaaatgaaagctgtcatttggttaaattaataaaaattctttcttagattttattctaaaaaa

SEQ ID NO: 193012 - DNA, 3336 bp, Homo sapiens
  Payload ID: 18109
  Gene Name: transmembrane (C-terminal) protease, serine 12
  ENST ID: ENST00000551456
  CDS Start-End: 46-1008
gcgggtgggaagtacctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcagaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcagggtaagaccaagtaattttcctttaaaatattttctgaagccagaagggaacttgtcaaacaaggcctttgataactttctggtggtcttaattatcaggcctaaaaataataaatcattttttctcctttttaactatttcaacaatccaaatcttcttggttcctgattccatggtttctgctgtcatcagtaggcagaatttaccttgaattcttttttttaatcattacctttgagatataattcacctagttaaaagtgtacagctcaattttttttttatttgagatagtctcgctttgtcacccatgctggagtgcagtgacacaatctctgttcactgcaacctctgcctcccaggttcaagcgattctcatccctcagcctcctaggtagctggaattacaggcacacatcactatgcccggccattctttttttttttttttgtattttcagtagagacagggcttcaccttgttgaccaggctggtcttgaactcctgacctcaagtgatctgcccaccttggcctcccaaagtgctgggattacaggggtgagccactgcgcccagcctgttactgtcttttttattataaccatccttgtgggtgcgcagtggtatctcatagtggttttaatttgcatttccttaatgactaatgatgttgagcatttttgcatgtatttattagccatttatatatcttctttacagaatgtctatttggatcccttcctcatttttaaattgagttgtctttttatcactgagttataagcatttttcatatattctggatacaagtcccttaccagatacataatgtacaaaatttttctcccattctgtagactgttttttcacttttctgaggttatcatttgcagcacaaatgttaatttttttaatgaagtacaattgatccattttttgttttgtctcatgcttttttactcttcctttattcctcttttcttcactatttccaaagctactagtccttcactcctgagtaacccatgctctcaccttttcctactcattctcatttctgcaatctaaagtttatcttttctgtgtccttttccttaaaaatcttgctgaatgaaatagtaaagaatccaatctaagtgaattgcattcctaggccaaacatcctcatcatcaaaaaataattattcaatgcctgccttatatagagaatcggaaacagttatctcagtgtccttgttgttttcagtgcattaacaggccttagtaacagcatttgggtgcattcctaattttgtatagactatgaaagtgacctgtcatttataatactactgagaggctttgccatttatgctcattttcctgcactagctattgtcaacacttagaaacttgtcttctattgcaagatgccagtttactcctctccctggcaagcaaaccacacacgtgcctaaaagaatccttcatacatcttaaagttatcctttccacacgcagtattcagcaagagaatattctaataatagacagttttgacaatattttgcacacttcctaaattatatttctcctaagtaattatatttaaaaatccaaacaatttgatttatagtattctggctcaaaaccaggcagatgagaaatttatctaccagctatatggttcctccaaatacctgggtaaaattgaattcctcctgtttgagttggaagtttaagctcaaaatctagtgatctttataaattgggggtatattgaaaatgtgtatttatataaatgtatgtttgatgtaaataatttattccagtgttactgttgcttgaagaatactagaagtaacaaacactattttgggacttttttgacagggtgacagtgggggaccattaatgtgctacttaccagaatataaaagattttttgtaatgggaattaccagttacggacatggctgtggtcgaagaggttttcctggtgtctatattgggccatccttctaccaaaagtggctgacagagcatttcttccatgcaagcactcaaggcatacttactataaatattttacgtggccagatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatattttatgtgtataaatgccaaataatagtttataattaaaatgaaagctgtcatttggttaaattaataaaaattctttcttagattttattctaaaaaa

SEQ ID NO: 193013 - DNA, 1771 bp, Homo sapiens
  Payload ID: 18110
  Gene Name: transmembrane 4 L six family member 1
  Uniprot ID: P30408
  ENST ID: ENST00000305366
  CDS Start-End: 319-927
attaatcattttccctgttgcctatgactgaggctgtttctcacatcctgcccctggttttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacca

SEQ ID NO: 193014 - DNA, 3115 bp, Homo sapiens
  Payload ID: 18110
  Gene Name: transmembrane 4 L six family member 1
  ENST ID: ENST00000472441
  CDS Start-End: 125-478
tgtggccatgaaaactgtggcaaacgatgtgcggtaggtcctcctgccctggtggtgaaaatgactcctaagatgtagctgtggcactctgtggctcacttcctgtgtgtctgcttttccctagatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacaggtaagaacctgcatgaaaatgtcgtagtctggccctggtgttaatataccattgttttcatcataaagaaaaaggcaaaaccaaacatgctcgacctaccagcatttattctgatatcatctttgtagcaacacaattatagcattcactttagctgtcagtaacaagcttcctcgagtctcacagtcacaggattgtcttagttctttgcagttggctctatgtacacaagaacatgctgcccatagacacagcgctcccttcaggatctaattcactgcctctgctctcgctgcagagacagaaaaaaaagtgatgtctgctctttgtttgctgttatattcccaactagtatacataagtaatagccaaccattcaatgcatcaggcactatgctaaacccatatgactcaaatattaagcaataggcttaagatcacctactcaggaaataacaggcttcaaaccttgagtcgctctgtgcaaaagctcctacttttaacctgtattccacacttgctgtttggttggattttctgcaattccttcctaataaggagtcataaaaatgcctaagcagtaagtatggagaatcactagcaatctttgaacagcagctcatgaaaagcctttcgttgtgaaagaaaaccaggaagcacttgtttcctggggatatgatttaggagaaaaaaatgcatttgtttgtagcagtgaaagttcttgtttctatatcctcctaaaatatatatattattgaattaatgaaagtccagctttgatcctatctttgagagggttattttatgtcttatatttttcaaaccatttactcctctggtgccagatctgttaactttcttttaaaaataagacaaaaacctaatgaaaactgaaagcccattgctaccatgaaaaactttgctgaaaataaaaggaaactttctgtaattttgggggaaggttaaaatgaaaatctagttttccttatcaggcaagtatagcaagattaataatttctttggcaaatttccaagaaaataagggaatgggaaaccttcaatatggagcttctttcaagcagtacggttggggaagggcagagaagtatcctctagggattgctgtcatgcagcttacctttagccttgaatttcatacaaggcagagttcaaagtaagtgattacttgtactaaatgtactcacttagtacgttttggggacaggcataaagagccaatgaccaaaatggctgaagtgatttggcagggaatgatactctcctctgatttggggtagtaaatacaccaggtttcccagctgagtcactgtagggatggcttcttcccagatactacagggaagatctgttacctttgtttataagacaaaagacactttcaaagggcaggtcttttcatgtagaagagtcaggtccataactcggtagcatttaatttgaaaggttacccacattgagctcataccagtgtgaaacttccatggcattatcttttaaatccctaagattaaaaccccacacaaatgcactcaaagcaacccaatatcagtatcctgcagtttctatgggccctttctgcagcctttactcatggaagacaagggatctgggtttgtttaggaaacattttgtgagcattgtccaagccctaagtatggttggcctaagctttgctgaagctaagatcagtctgtttatgtttgcttaaaataggaacttaaaggactaaaatgtcatcattatttatcctgattatagcctaatggtattttattttctctacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacc

SEQ ID NO: 193015 - DNA, 702 bp, Homo sapiens
  Payload ID: 18110
  Gene Name: transmembrane 4 L six family member 1
  ENST ID: ENST00000493298
  CDS Start-End: 103-414
agtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcggtaggtcctcctgccctggtggtgaaaatgactcctaagatgtagctgtggcactctgtggctcacttcctgtgtgtctgcttttccctagatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttgg

SEQ ID NO: 193016 - DNA, 976 bp, Homo sapiens
  Payload ID: 18110
  Gene Name: transmembrane 4 L six family member 1
  ENST ID: ENST00000493348
  CDS Start-End: 146-451
actaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcggtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgt

SEQ ID NO: 193017 - DNA, 1646 bp, Homo sapiens
  Payload ID: 18110
  Gene Name: transmembrane 4 L six family member 1
  ENST ID: ENST00000622124
  CDS Start-End: 196-894
agagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcactgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaaatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtaatttacagactgagtgacagtactcagtatatctgagataaactctataatgttttggataaaaataacattccaatcactattgtatatatgtgcatgtattttttaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggactgattgagaatgttccaatccaaatgaatgcatcacaacttacaatgctgctcattgttgtgagtactatgagattcaaatttttctaacatatggaaagccttttgtcctccaaagatgagtactagggatcatgtgtttaaaaaaagaaaggctacgatgactgggcaagaagaaagatgggaaactgaataaagcagttgatcagcatcattggaacatggggacgagtgacggcaggaggaccacgaggaaataccctcaaaactaacttgtttacaacaaaataaagtattcactacc

SEQ ID NO: 193018 - DNA, 3852 bp, Homo sapiens
  Payload ID: 18111
  Gene Name: transmembrane 4 L six family member 18
  Uniprot ID: Q96CE8
  ENST ID: ENST00000296059
  CDS Start-End: 267-872
aacacaaggtcagggttaagccttcggtgctttaatccagaggaaaattacttattttaaaaagcagtgaaaaacaccgcattcctttggcacaggatgaagaccagctcagctcttcagttgttgatcattgtctattgttctccaaacagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaacttcagaaatacttctgccctttgatcaaacaaatccatttccaagaatctgtactagggaagtaaataagaatatgagagaaacctttatgcaaatatgtatattgcaacattatttaatattctggaaaattggaaacaccccaaaattctaaactcagaggaaggattaagtaaagagtggtacatactgtaaatgttttctgatattaaaaaaaaaattaaataaaaaataaagagtactacatggttgtaaaattacagtcattacaaatgatgtttttaaaattatgaataatgctacatcaaaaagcaggttacaaattcatgtttactatataactatttaaagcaaatgaaacactaatagtcaaagtttaggatgaaaactaaatctaaaaggaaatataacaaaatgccaattatgcttggtttggggcattgatgacccttcttcccacttttctatattttccaagatttctttattgaatatgttttactataaatattttctaaactcatattttcactattaaaatttttttatttttccaaactttaaggcatatgctctttccacattcctcaacattatttgcaaacatcatgaaatgacacttccatcaacattcaatgaggaaagtagtgatatagatgagccaaaaagagttttatataaacttatacaatctaaactcttgctcttcctttctgactcctgagggtgagtgtgatggactagaagaggtagccttaaaataagtgagcagctagggaacatgctcaatgggcaagagaaaatgaccactgaccagtcaatacctgtgtcagggggagttaccagtacctatatttatttttaaagtaattaaaaagtagaacacttacaaattttccacctatacatgccatgtcttcctcggggacagtagccacatcttatatatttcccaccatgcataggacccagcacacagtgaagccagtaggcactcagtgttgaatgctcataccaggttttctgcttcctgtagttaccctgctgagcactgcttccatcacaggtgcactgggcctcaacacttctgccatttccccatttgtctcctccatggacactgtcaacaatggtctgtcaacacctgctctgtgccaaagccagggagtaggctggggggatacggaagagaatatctttctccttgatgcctgctgtgccaacagccccctttaagccttgttcacagcctttgctgaaacaagcatcttgaaagcaagccatgttatacaccgcatgaccttcatgctctgggcccagctgactgaactggggcaggccccagagtcatgggcagcctattgtcttgctaatggcctctgacttagcctggagtaaaacactgtccaaacaagactggtggttattcaagcataagaatttgaactaggaagccaagaatgaagcaaccggaccattaccatcaaaaaatgattaaaggatgaagaaggaagccaacattcagagagtatctggttcatgttaataatggtatcatattaaaaggaagatacatgaacttctactccaaaagctcctaaaactgcctttgcccacaatgaacagtgtaccctaggcctggtttctgttcttggattcctagatagtctttcttctttgtcactgtgctgatcatttcagtaaacccccgactaaatcagtgcagctctgtttattgcaactaaaacgatccaaatgaagtctcccttttctagatgttgggttggagggatgctaagacaaagatgcttaggctccagagttttacagagcttcattcaataacactctactttccaaagaacttaaatatgaggtctgaaggacttggaccaagaggcaaacccaagctacagacaccatgttgtactcagagtgacctctcccctctgacagcccaggatttctctatcaagtccataagctagtcatatctaggaccatcttgttaaaaattctctcaaagtctcctcagccctcttgtaaacagacttctggaaggtccacttcatcagtttgttatatactttcagactgtctatctcttgtttagattcagcatggcaccgtacgttgaatggactgttaatagatgtttgctgaatgactccaccacagcattggacacatcaggggtacagccaaatgcagcatgatacctctatcaggaaaattaaattttaacacagccaccaaatattctatatttgaagagtatatgctaatcatgcaattttaagtaaaaaaaagctgaatacaaaaaaagctgaatatgtgttttatatcctcgtgaattcaaagtaaaaaggaaaaaaaactcaaaaaccaaatatatgtatgcagtttgagcccaaatttttaattaagtaaccatataattacatgtagacatgtataaaccttgagatatgtaaagaccagaaaaatatttaaaagttaatagttacatcatctgtggtcacaacaccctgaaaatgcctaatattggaaacttaagcaggattgatccaggttattacttggatgggagaccagatgctataggctgaaaaaagaaagcataagtacgcacaagttaatacttaataattatctcctaatgataggactataagttctatctcttttctttacattgttcagtattttcaaatttccctttgaaaatgtgttatgtacttgaattattagaaaaaataaatgtcatttaaaaagcaa

SEQ ID NO: 193019 - DNA, 662 bp, Homo sapiens
  Payload ID: 18111
  Gene Name: transmembrane 4 L six family member 18
  ENST ID: ENST00000474754
  CDS Start-End: 184-662
gtcttactttgtcacccaggctggagtgcagtggaacgatctcggctcactgcaacctccgtctcccagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcat

SEQ ID NO: 193020 - DNA, 907 bp, Homo sapiens
  Payload ID: 18111
  Gene Name: transmembrane 4 L six family member 18
  Uniprot ID: Q96CE8
  ENST ID: ENST00000470080
  CDS Start-End: 101-706
gagagagagagagaaaaaaaaggtcaggtaggaagaagaaaaatagactttctgtgactgtatactcttgaaatctcccgcaggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaa

SEQ ID NO: 193021 - DNA, 1022 bp, Homo sapiens
  Payload ID: 18112
  Gene Name: transmembrane 4 L six family member 19
  Uniprot ID: Q96DZ7
  ENST ID: ENST00000273695
  CDS Start-End: 127-756
aaagagtcctggaaagacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagc

SEQ ID NO: 193022 - DNA, 1061 bp, Homo sapiens
  Payload ID: 18112
  Gene Name: transmembrane 4 L six family member 19
  Uniprot ID: Q96DZ7
  ENST ID: ENST00000454715
  CDS Start-End: 242-793
ctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagcca

SEQ ID NO: 193023 - DNA, 1582 bp, Homo sapiens
  Payload ID: 18112
  Gene Name: transmembrane 4 L six family member 19
  ENST ID: ENST00000446879
  CDS Start-End: 127-1026
aaagagtcctggaaagacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtggagtctcatgctggagtgcagtggtgtgatctcggctcactgcaagctccgactccctggttcaagcaattctcctgcctcagcctcccaagtagctgggattacaggcacatgccaccacacccagctaatttttgtatttttagtagagaccgggtttcacaatgttagccaggatggtcttgatctcctaacctcatgatccgcccgcctcggcctcccaaagtgctgggatcacaggtgcgagtcaccgtgcctggccaactaatgaaaagtttaaagaatttatatctagttttggatgttaggcatgcacacacaagtgcatgcacactcatacacatcatctccacaagccccatcctggctcagccctattctgatgggtcagcaggaccccaaggagagaagggtgggtccttggcactaagacagttcacagtggttagctgactccttcttgcctccattctttcaggaactgcatatagtacagaacatgacagcgattcgaaaaacaatatcccagctggctgtgatggctcatgcctgtagtcccagcacttcggaaggctgaggtgggataatcacttgagcccaagagttcaatagtagcctgggcagcatagccagatcctatctctacaaaaattaaaaagattagccacgcgcggtggcattcgcctgtagttccaggtactccagaggctgaggtgggaggactgcttgagtccaagaggtcgaggctgaagtgagcg

SEQ ID NO: 193024 - DNA, 500 bp, Homo sapiens
  Payload ID: 18112
  Gene Name: transmembrane 4 L six family member 19
  ENST ID: ENST00000440822
  CDS Start-End: 1-332
atcagacacaagcttggaaatatggttacccattcaaagacctgcatagaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagccaggg

SEQ ID NO: 193025 - DNA, 2296 bp, Homo sapiens
  Payload ID: 18113
  Gene Name: transmembrane 4 L six family member 20
  Uniprot ID: Q53R12
  ENST ID: ENST00000304568
  CDS Start-End: 39-728
atagccactttgacaacgtttctgagccaggggtgaccatgacctgctgcgaaggatggacatcctgcaatggattcagcctgctggttctactgctgttaggagtagttctcaatgcgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcacttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaattaatttgagaagtacacttgttttcaaagtcatctttgagatgatttaaaaaatcaacccttcacgtagaaagcacgttgtaaatgcataacactctcatatcagtggttgatttgggaaaggtggagagaattttcaattagttttgtgttgtactattcaaattttttacctcttcactgtgtgtagagaaaggagaagggaaggaggatgagaaggaacggaagtcatcctgaaaataaaagtacaggactttttttttttttttttgagacagggtctcaaaaaaggctggagtacagtagtacagtggtgctatctcagcttactgcagcctcaacctcctgggctcaggtgattctcccatctcagcctccctagtagctgggactacaggtgcgtgccactatgccaagctaatttttgtatttttagtagagatgggggttttccatattgcccaggctggtcccgaactcatggactcaagtgatctgcctgcctcagcctcctaaagtgctgcgattacaggcatgagccatcgcgcctaaaggacaggacctttttattgtatttctttaaagaataaatacataacctgaatgcaatcaagtctttagatctaattctcagcttgcagggaacactaggacaaatccaaaaagtgggtcagcgggcacagaatggcccaattttcaacaggaaaatgttataaaagaaaaatatttttgagggaactgttatagattaagagaatagaggcatgtttcagctaaacacatgtaaactttgtcagagataattgggaggagtatgtagaagaatcggattattgttaattttggtaggtctgataatggttttatagtataaaggctgagtaccccttatccaaaatgattaagatcagaagtgttttggctttcacatttttttggattttggaattttgcctataataatgagacatcttggggatgggatgcaagtctaaccacaaaattcatttatgtctcatacacactttgaacacctggcctgaaggtaatttcacacaatattttaaataactttgtgcatgaaacacaattttgactgcattttgactgcaactcatcacatgaggtcaggtatggaattttccacttgtggtgttacgttactggctcaaaaagttttggatctcggagcattctggattttgaatttttggattagtgatgctcaacctgtatacagaaatgtcctcatttttaaaaaaagaaatgcatatttatatgttttaaaattacttcaaccaaaagcaacggggagatgtttactgttatatttaggtgacaggtacatggcaattcattataccctcctattttcctatgtttacattattcattaattaaaaaacaatacctagaaaaacccaagactttcaaaagctattttctatatgtgccaatctttaaaaaacaggataacaagggtatttatcacattaaaatgttgtaaaacagcaaagctaaaaatctaaaa

SEQ ID NO: 193026 - DNA, 542 bp, Homo sapiens
  Payload ID: 18113
  Gene Name: transmembrane 4 L six family member 20
  ENST ID: ENST00000449706
  CDS Start-End: 500-542
aaacaggcacgtgtgttgggcagatactaaaaagtggtcatcattctcctcttcagttataagctaattctcttttcagctttatactgaaatatcttccccttcatcacatacagattaaatttctacatttttacagaattcttcagatacttccttttagccacaaatgtaaggagtactaaacccgagtggaactatgttatgcccactagcaaaagcatgcagcttactcagttttggtcaaatggcaaagactctggaaatcagacacttgattctcacagtcaggtggagtccaaccgatccagttccctacatataaaatgattccctaaacagttcttcaattcaacatcttatgaagacagcaaaaagatttgaaatggcacaacccacattctaagcgttaaattttaaccagaagattgggataaaaggcaacatagtaccatgcaagcatagccactttgacaacgtttctgagccaggggtgaccatgacctgctgcgaaggatggacatcctgcaatggattcagcc

SEQ ID NO: 193027 - DNA, 2101 bp, Homo sapiens
  Payload ID: 18114
  Gene Name: transmembrane 4 L six family member 4
  Uniprot ID: P48230
  ENST ID: ENST00000305354
  CDS Start-End: 905-1513
gtcaactcatcaggaccttttctctccctctctaccaatgctgaccttcctttccccttagccttagtggatgatggtttctttattcctatatggaagacatagctgagaaagttgattaggaaaactgtttttgctaattccatcacatcgtgtagggaaaagatagaacttaattacttaattgcgtaacaagtagagaaacacagcaatcagacaataaaatgaacagtagctttttgccttaaacaattcttttaagtctgagctcaatgatacacaactagaccatcaaattattttgatattgaggaaaacagaagctcttttggataaccctgaattccaggctttcagtggaaaagacaaagacacgcactgtacaccattaagtacttgggagacatgattttaaccaggatgtaactcaattatattagtgatttataaagagtctggagaaaatatttctttatttgggcatgggcactgtcagattaaaggtgcagtggttctaaatgctgtttgttccagccctgtcttcgattgcaacaatgtgagtgtcttgtctgtgctggtggattattaacagaggttattggtctccatggcaaaacgattgaatgattgctctgaacgtaatctcatttatgggggtgcaaaaaacaaagcacttcaggtcagggagaatgtataaatgtccattgccatcgaggttctgctatttttgagaagctgaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgatcttccctgcgctggtgttcttgggcctgaagaacaatgactgctgtgggtgctgcggcaacgagggctgtgggaagcgatttgcgatgttcacctccacgatatttgctgtggttggattcttgggagctggatactcgtttatcatctcagccatttcaatcaacaagggtcctaaatgcctcatggccaatagtacatggggctaccccttccacgacggggattatctcaatgatgaggccttatggaacaagtgccgagagcctctcaatgtggttccctggaatctgaccctcttctccatcctgctggtcgtaggaggaatccagatggttctctgcgccatccaggtggtcaatggcctcctggggaccctctgtggggactgccagtgttgtggctgctgtgggggagatggacccgtttaaacctccgagatgagctgctcagactctacagcatgacgactacaatttcttttcataaaacttcttctcttcttggaattattaattcctatctgcttcctagctgataaagcttagaaaaggcagttattccttctttccaaccagctttgctcgagttagaattttgttattttcaaataaaaaatagtttggccacttaacaaatttgatttataaatctttcaaattagttcctttttagaatttaccaacaggttcaaagcatacttttcatgatttttttattacaaatgtaaaatgtataaagtcacatgtactgccatactacttctttgtatataaagatgtttatatctttggaagttttacataaatcaaaggaagaaagcacatttaaaatgagaaactaagaccaatttctgtttttaagaggaaaaagaatgattgatgtatcctaagtattgttatttgttgtctttttttgctgccttgcttgagttgcttgtgactgatcttttgaggctgtcatcatggctagggttcttttatgtatgttaaattaaaacctgaattcagaggtaacgt

SEQ ID NO: 193028 - DNA, 422 bp, Homo sapiens
  Payload ID: 18114
  Gene Name: transmembrane 4 L six family member 4
  ENST ID: ENST00000465758
  CDS Start-End: 180-422
ttttgagaagctgaagcaactccaaggacacagttcacagaaatttggttctcagccccaaaatactgattgaattggagacaattacaaggactctctggccaaaaacccttgaagaggccccgtgaaggaggcagtgaggagcttttgattgctgacctgtgtcgtaccaccccagaatgtgcactgggggctgtgccagatgcctgggggggaccctcattccccttgctttttttggcttcctggctaacatcctgttattttttcctggaggaaaagtgatagatgacaacgaccacctttcccaagagatctggtttttcggaggaatattaggaagcggtgtcttgatgttcacctccacgatatttgctgtggttggattcttgggagctggatactcgtttatcatctcagcc

SEQ ID NO: 193029 - DNA, 708 bp, Homo sapiens
  Payload ID: 18115
  Gene Name: transmembrane 4 L six family member 5
  Uniprot ID: O14894
  ENST ID: ENST00000270560
  CDS Start-End: 32-625
actcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccggggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctc

SEQ ID NO: 193030 - DNA, 1469 bp, Homo sapiens
  Payload ID: 18116
  Gene Name: transmembrane 6 superfamily member 1
  ENST ID: ENST00000258909
  CDS Start-End: 24-461
gggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaa

SEQ ID NO: 193031 - DNA, 2074 bp, Homo sapiens
  Payload ID: 18116
  Gene Name: transmembrane 6 superfamily member 1
  Uniprot ID: Q9BZW5
  ENST ID: ENST00000322019
  CDS Start-End: 275-1387
gtggcgcccctggcaggagcactgcaaggacgcctcccgggactgcaccgcggccctgcgcacttggggcgacggggccaggcgcgggggacggctgcgggctgggagggcgcgcggaggagacaccgctgaggggacgccgctgagggcgccacgcggggggcgcggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctctta

SEQ ID NO: 193032 - DNA, 1808 bp, Homo sapiens
  Payload ID: 18116
  Gene Name: transmembrane 6 superfamily member 1
  ENST ID: ENST00000379384
  CDS Start-End: 34-435
atgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggagtaagtcagttcacctggtgtgtgcctttgccaccttagcaaccgataagcggggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaaaggatcctgctgcttatcctaaaattcagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaac

SEQ ID NO: 193033 - DNA, 1638 bp, Homo sapiens
  Payload ID: 18116
  Gene Name: transmembrane 6 superfamily member 1
  ENST ID: ENST00000379390
  CDS Start-End: 110-676
cggctgaggcgcctcgaagggcaagcgccaagggggcgcgggcgccgccggaagctggggcggggcgcccagcgggatgcggtgaagggcgagcggcgcggcggctgcgatgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataaaaatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttgaaggaaaatggaaattcttgagaaacagtttgtttaaagaaatatattcaaaatcatttgtgaataaacttgatcatccatctcaatattgtttgacatataaaataattataagtgtaaaaaattacaatttagtgccaacagtagtgagcatgaaatgaaactattcaaaagagaatatggcctgtgcatattaaaaaattcaaaacagtgaatgcagactggaggagtaacttttgcaaataagatgaatatgcttcattattaaactcaatataaaaggcaaatcatcagaatatttttaaatgttgtttgaaaaatgttttcccaaggaaagtttattatttgctgctgtttcaagaaaattacttttactaaatttttttgtgtgaatttaaacagctaaatagggatcagtaactttatctctatccttaatgaacatttgttttattggtggctggaaatatttctattgtatttctgtgtatatttttaataaaattatttttggcctcttataaagacaaatcttattaaatttgaaacatttcatatatacacataaaa

SEQ ID NO: 193034 - DNA, 856 bp, Homo sapiens
  Payload ID: 18116
  Gene Name: transmembrane 6 superfamily member 1
  ENST ID: ENST00000565982
  CDS Start-End: 358-856
gtgctgtccctctcggccatcccggtcacctatgtcttcaaccacctggcggcccagcatgagtgagtgagccggcgcggcgggggtcgcgccgaggggcggcgggagttggctcgccgcgacgggagcctcgcaacttttccgagggggctgggaccgtccgccgcgggacagagttcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgattgctttggattgcccatctgagctctgccgattatatacgcaatttcaagagccctatctaa

SEQ ID NO: 193035 - DNA, 407 bp, Homo sapiens
  Payload ID: 18116
  Gene Name: transmembrane 6 superfamily member 1
  ENST ID: ENST00000561551
  CDS Start-End: 1-92
tgtatggcttagtggttcctggatgttcctggatgcctgacatcacattgatacatgctggaggtctggctcagccagctgccatgctgtgagctgcctcatggtgagatccatggggcaaggcatcagaggaggcctctgggaaacaactcatgaggaactgaggcctccagtccaacaaccgtgaggagctgaatcctgccaggaacaatttgagtgatcttagaagaggatccatccccagttgagccttaagatgatctgagttcctgctgacacctggactgcattttggtatctcagttccttttgcaagagacccagagccagaggatttagcaagttgcacctgaatggactgttgatgagtcttgaaaagatgagataataaatgctgctttaagtca

SEQ ID NO: 193036 - DNA, 1020 bp, Homo sapiens
  Payload ID: 18116
  Gene Name: transmembrane 6 superfamily member 1
  Uniprot ID: Q9BZW5
  ENST ID: ENST00000565774
  CDS Start-End: 1-1020
atgagtgcctctgcggccaccggggtcttcgtgctgtccctctcggccatcccggtcacctatgtcttcaaccacctggcggcccagcatgattcctggactattgtaggggttgctgccctcatcctgttcctggtagcactgctggctcgtgtcctcgtcaaaagaaaaccaccccgggacccactgttctatgtgtatgcagtttttggatttaccagcgtggtgaacctcatcataggactggagcaagatggaatcattgacgggttcatgacacactacttgagagagggtgaaccgtatctgaacaccgcatatgggcacatgatctgctactgggatggctctgctcattatctgatgtacctggtgatggtggcagccatagcatgggaggaaacttatagaaccattggcctatattgggttggatctattattatgagtgttgttgtttttgtgccaggaaacattgtagggaagtatggaacacgaatttgccctgcttttttcttaagcataccatatacttgtcttcctgtctgggctggtttcagaatctataatcagccatcagaaaattataattacccctcaaaggttattcaagaagcccaagcgaaagacctgctgagaagaccatttgatttaatgttggttgtgtgtctcctcctggcaactggattttgcctgttcagaggtttgatgctggcatatatgttctattctgttccttactttgtgactgcactgtatggcttagtggttcctggatgttcctggatgcctgacatcacattgatacatgctggaggtctggctcaggctcagttttctcacattggtgcatctcttcatgctagaactgcttatgtctacagagtccctgaagaagcaaaaatcctttttttagcattaaacatagcatatggagttcttcctcagctcttggcctatcgttgtatctacaaaccagagttcttcataaaaacaaaggcagaagaaaaagtggaataa

SEQ ID NO: 193037 - DNA, 1505 bp, Homo sapiens
  Payload ID: 18117
  Gene Name: transmembrane 6 superfamily member 2
  Uniprot ID: Q9BZW4
  ENST ID: ENST00000389363
  CDS Start-End: 74-1207
actcgccgccaacgaggagccgagcgccctggagaacgcgtcggggctgagccggggtccagcagccgccgctatggacatcccgccgctggccggcaagatcgcggcgctgtcgctgagcgccctcccggtgtcctacgcgctcaaccacgtctcggcgctctcgcaccccctgtgggtggcattgatgagcgccctaatcctgggtctgcttttcgtggcggtctacagcttgtcccatggcgaggtctcctatgacccactctatgctgtcttcgctgtcttcgccttcacctcggttgtggacctcatcatcgctcttcaggaagacagctatgtggtgggcttcatggagttctacaccaaggagggagagccatacctgcgcacagcgcacggagtcttcatctgctactgggatggcactgttcactacctcctctacctggccatggccggcgccatctgcagaaggaagagataccggaattttggactctactggctgggttccttcgccatgagcatcctggtgttccttacaggaaacattcttggcaaatacagctccgagatcaggcctgccttcttcctcaccatcccctacctgctggtgccatgctgggctggcatgaaggtcttcagccagccccgggcgctaacccgctgcaccgccaacatggtgcaagaggaacaaagaaagggactcctgcagcgtccggctgacctggcccttgtcatatatctcatccttgctggcttcttcactctgttccggggcctggtggtgcttgattgccccacagatgcctgctttgtctatatctaccagtatgagccatacctgcgggaccctgtggcctaccctaaggtgcagatgctgatgtacatgttttatgtcctgcctttctgcggcctggctgcctatgctctcaccttccctggttgctcctggcttccagactgggccttggtgtttgctggaggcatcggccaggcacagttctcgcacatgggggcttccatgcacctgcgcacacccttcacctaccgtgtgcctgaggacacctggggctgcttcttcgtgtgcaatctgctgtatgcgctgggcccccacctgctggcctaccgttgccttcagtggcccgcattcttccaccagccaccaccctccgaccccctagccctccacaagaagcagcattgagagagctgtggactcaggacccaggactctgtttacgtgcccagtcagccctacctggggaagcgggggttgggtgttttagagacaggagggacatctccgggtgtctttagtcttggctatggtagtttcagtccagtgggtgggatggagaccaacgaccaagtgttcctgcaaggagagcctcccacagctgtcaccatgctccaactcccacacaaacgcttctaccccttccagaacttacccatcatccccccatggatcctttcagtaaaaaccctttcaatttccaaaa

SEQ ID NO: 193038 - DNA, 1722 bp, Homo sapiens
  Payload ID: 18118
  Gene Name: transmembrane 7 superfamily member 2
  Uniprot ID: O76062
  ENST ID: ENST00000279263
  CDS Start-End: 163-1419
gggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggagatgctcttcctcctttggataaacactgggaacccttggtgcacttctctcccctaggactggctgggtcagcactgatcagggagaagctgagcagtggcttgtgggcccaggaatctg

SEQ ID NO: 193039 - DNA, 1490 bp, Homo sapiens
  Payload ID: 18118
  Gene Name: transmembrane 7 superfamily member 2
  Uniprot ID: O76062
  ENST ID: ENST00000345348
  CDS Start-End: 133-1308
tgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcgga

SEQ ID NO: 193040 - DNA, 945 bp, Homo sapiens
  Payload ID: 18118
  Gene Name: transmembrane 7 superfamily member 2
  ENST ID: ENST00000531321
  CDS Start-End: 132-945
tccaggcaggtgcaggcgccgcggggccggatcctccgcgcggccgagtccatctcctgggaaatggggcggacagtgtttccttgactgactattgcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcg

SEQ ID NO: 193041 - DNA, 544 bp, Homo sapiens
  Payload ID: 18118
  Gene Name: transmembrane 7 superfamily member 2
  ENST ID: ENST00000527968
  CDS Start-End: 1-544
ccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctggggtgtcacacctgctgccctacttctacctcctctacttcaccgcgctgctggtgcaccgtgaggcccgggatg

SEQ ID NO: 193042 - DNA, 829 bp, Homo sapiens
  Payload ID: 18118
  Gene Name: transmembrane 7 superfamily member 2
  ENST ID: ENST00000526809
  CDS Start-End: 172-829
aaaaaccctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgc

SEQ ID NO: 193043 - DNA, 913 bp, Homo sapiens
  Payload ID: 18118
  Gene Name: transmembrane 7 superfamily member 2
  ENST ID: ENST00000534371
  CDS Start-End: 145-913
gtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctg

SEQ ID NO: 193044 - DNA, 365 bp, Homo sapiens
  Payload ID: 18118
  Gene Name: transmembrane 7 superfamily member 2
  ENST ID: ENST00000530750
  CDS Start-End: 19-365
tccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcaatccgatttacgacttttttctgggacgagagctcaaccc

SEQ ID NO: 193045 - DNA, 749 bp, Homo sapiens
  Payload ID: 18118
  Gene Name: transmembrane 7 superfamily member 2
  ENST ID: ENST00000529414
  CDS Start-End: 127-749
ggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcagagctcaaccctcgtatctgtttcttcgacttcaaatatttctgtgaactgcgacccggcctcatcggctgggtcctcatcaacctggccctgttgatgaaggaggcagagcttcgaggcagtcc

SEQ ID NO: 193046 - DNA, 1014 bp, Homo sapiens
  Payload ID: 18118
  Gene Name: transmembrane 7 superfamily member 2
  ENST ID: ENST00000525385
  CDS Start-End: 139-1014
ttccgtgtccaggcaggtgcaggcgccgcggggccggatcctccgcgcggccgagtccatctcctgggaaatggggcggacagtgtttccttgactgactattgcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgacccc

SEQ ID NO: 193047 - DNA, 570 bp, Homo sapiens
  Payload ID: 18118
  Gene Name: transmembrane 7 superfamily member 2
  ENST ID: ENST00000526085
  CDS Start-End: 126-570
gcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatg

SEQ ID NO: 193048 - DNA, 843 bp, Homo sapiens
  Payload ID: 18118
  Gene Name: transmembrane 7 superfamily member 2
  ENST ID: ENST00000524690
  CDS Start-End: 1-280
ggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggtgcctaggggacgggccctcgcgctggagcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccg

SEQ ID NO: 193049 - DNA, 1671 bp, Homo sapiens
  Payload ID: 18118
  Gene Name: transmembrane 7 superfamily member 2
  ENST ID: ENST00000529601
  CDS Start-End: 139-408
gttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggagatgctcttcctcctttggataaacactgggaacccttggtgcacttctctcccctaggactggctgggtcagcactgatcagggagaagctgagcagtggcttgtgggcccaggaatctggggtctggtgggacaatagctatccctc

SEQ ID NO: 193050 - DNA, 729 bp, Homo sapiens
  Payload ID: 18118
  Gene Name: transmembrane 7 superfamily member 2
  ENST ID: ENST00000524986
  CDS Start-End: 60-729
tccttgtctgcgttccgtgtccaggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggcaatccgatttacgacttttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatg

SEQ ID NO: 193051 - DNA, 692 bp, Homo sapiens
  Payload ID: 18118
  Gene Name: transmembrane 7 superfamily member 2
  ENST ID: ENST00000528802
  CDS Start-End: 1-626
tttttctgggacgagagctcaaccctcgtatctgtttcttcgacttcaaatatttctgtgaactgcgacccggcctcatcggctgggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcgaccctggcgcttttgctgctgagccccgatgcccacatgagccatgaggggtgtcacacctgctgccctacttctacctcctctacttcaccgcgctgctggtgcaccgtgag

SEQ ID NO: 193052 - DNA, 1305 bp, Homo sapiens
  Payload ID: 18118
  Gene Name: transmembrane 7 superfamily member 2
  ENST ID: ENST00000529292
  CDS Start-End: 128-535
aggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggcgccgcggctctgctactgctgctgcccgccaccatgttccacctgctcctggcggcccgttcgggccccgcgcgcctgctgggtccacccgcgtccctgccggggctggaggtgctgtggagcccacgggcgctgctgctgtggctcgcctggctcggcctgcaggcggcgctctacctactgccggcgcgcaaggtggccgaggggcaggaattgaaggacaagagtcgcctgcgctatcctattaacggtcctcatcaacctggccctgttgatgaaggaggcagagcttcgaggcagtccctcactggccatgtggctggtcaatggcttccagttgctctacgtgggtgatgccctctggcacgaggaggccgtcctcaccaccatggatatcacacatgacgggtttggcttcatgctggcgtttggggacatggcctgggtgcccttcacctacagcctgcaggcccagttcctgctgcaccacccgcagcccctggggttgcccatggcctctgtcatctgcctcatcaatgctactggttactacatcttccgtggggcgaattcccagaaaaacactttccgaaagaatccttctgaccccagagtggctgggcttgagaccatctctacagccacagggcggaaactgctggtgtctgggtggtggggtatggtccgccatcccaactatcttggagacctcatcatggctctggcttggtccttgccctgcggggtgtcacacctgctgccctacttctacctcctctacttcaccgcgctgctggtgcaccgtgaggcccgggatgagcggcagtgcctgcagaagtacggcctggcctggcaggagtactgccggcgtgtgccttaccgcatcatgccctacatctactgaagcggctccaccaccccaggtgggggcatgtgcccactcatccaccagcacacccaggaccaggagcctcgacacacttgggactcaagggcttgcaccccacccagccctgaggatgaacaacctcagagaagaggtggtttagagcaaggaaaaaaatgaaaccagtgaccaaaatcggagatgctcttcctcctttggataaacactgggaaccctt

SEQ ID NO: 193053 - DNA, 2709 bp, Homo sapiens
  Payload ID: 18119
  Gene Name: transmembrane 7 superfamily member 3
  Uniprot ID: Q9NS93
  ENST ID: ENST00000343028
  CDS Start-End: 227-1939
gttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgagggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagaggacgaccgttcttccctccccacccatacaagttatggaagcaagagagagagcgccgagtgacaaacattctggaccctagctaccacattcctccattgagagagaggctctatggccgattaacccagattaaagggctcttccagaaggagcagccagctggagagagaacgcctttgcttctgtagatgcccaggggcttggtcagtgtgcctcagctttggagttcatgcctggagtggttcaacagtctctggtgcaagtctaataagagatcaggcatatatatctgttctttgcataatattatggtgcccttattgatatatggtaagggtgtactaggggattaggatgattgtaagagaatgagaaagatgaccaaaaggttggtggtagggaggctttttcttatttccaaatacttgagaaattaccttttggtttacaaatctatgatcaacttattccattaaatagatacattaaaaaaattaaaaactgattcttctgcagagcactggtgtttctttttataaccccttgaaacaagtctctcacctgagcctgtctaaactttcggagggagtttattattgagtctttatctgtgacagtatttggagatttagggatttgatacttaggcctttgaattttagaatacaaaaagagaagcaagccagacatggtggctcacacctgtaatcccaatactgggaagccaaggtgggagtatcgcttgagcccaggagtttgagaccgacatgggcaacatgacaagaccccatctctacaaaaaaattaaaaaattagccaggcatggtggcacatgcctactcccagctcccaaggagactgagatgggaggatccctggagccctgaagattgaggctacagtgagccttgattgtgtcactgcactccagcttgggtgacagagaccctgtctcgag

SEQ ID NO: 193054 - DNA, 537 bp, Homo sapiens
  Payload ID: 18119
  Gene Name: transmembrane 7 superfamily member 3
  ENST ID: ENST00000535423
  CDS Start-End: 427-537
aaacctctcgctggggctaggagttcggcggggcgcgcgccggcggctgcggagctggcaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgatttggaataggacatgcacactggatcagctcagtaatttatgttttggtcgacttcctattcatgacaatgtttcttctggactgcagactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaa

SEQ ID NO: 193055 - DNA, 883 bp, Homo sapiens
  Payload ID: 18119
  Gene Name: transmembrane 7 superfamily member 3
  ENST ID: ENST00000535260
  CDS Start-End: 1-601
gttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactggagacaggatctctttctgtcacccatgctggactgcagtgacactatcatagctcactgcaacctcaaactctaaggctcaagccatcctcttacatcagcctcccaagtagctgggactacaggtgtgtgctgccatgcctggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcct

SEQ ID NO: 193056 - DNA, 579 bp, Homo sapiens
  Payload ID: 18119
  Gene Name: transmembrane 7 superfamily member 3
  ENST ID: ENST00000545600
  CDS Start-End: 231-579
gcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggtttatctcgttgtaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtact

SEQ ID NO: 193057 - DNA, 541 bp, Homo sapiens
  Payload ID: 18119
  Gene Name: transmembrane 7 superfamily member 3
  ENST ID: ENST00000545303
  CDS Start-End: 1-434
gtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatgctgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatg

SEQ ID NO: 193058 - DNA, 623 bp, Homo sapiens
  Payload ID: 18119
  Gene Name: transmembrane 7 superfamily member 3
  ENST ID: ENST00000512808
  CDS Start-End: 278-623
tttttttttttttttttttgacggagtctcgctctgtcgcctaggctggagtgcagtggcatgatcttggctgactgcaacctccgacacccgggttcaagcaattctcctgcctcagcctccagagtagctgggattacaggcgcccgccaccacacccagctagtttttgtatttttagtacaggcggggtttcaccatgttgttcaggctggtctcgaactcctgacctcgtgatctgcccgccttggcctcccagagtgctgggattacaggcatgagccaccgcgcccggccgatttcaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctg

SEQ ID NO: 193059 - DNA, 737 bp, Homo sapiens
  Payload ID: 18119
  Gene Name: transmembrane 7 superfamily member 3
  ENST ID: ENST00000542019
  CDS Start-End: 206-355
gaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctc

SEQ ID NO: 193060 - DNA, 762 bp, Homo sapiens
  Payload ID: 18119
  Gene Name: transmembrane 7 superfamily member 3
  ENST ID: ENST00000543882
  CDS Start-End: 1-459
gaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctagctgtgctgtacctgcttctctgcctctccacctcatcaccctcctttatcactggattattttaaagcaaatccctggtcatcatgttactcacaaatatttcagaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatggaaacctaaagatttttcatgatgatggtgtattctgggtcactttctcttgcatagctatcctcattccagtagttttcatgggctgcctaagaa

SEQ ID NO: 193061 - DNA, 573 bp, Homo sapiens
  Payload ID: 18119
  Gene Name: transmembrane 7 superfamily member 3
  ENST ID: ENST00000539741
  CDS Start-End: 314-573
agaggaaacctctcgctggggctaggagttcggcggggcgcgcgccggcggctgcggagctggcaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgagga

SEQ ID NO: 193062 - DNA, 568 bp, Homo sapiens
  Payload ID: 18119
  Gene Name: transmembrane 7 superfamily member 3
  ENST ID: ENST00000543655
  CDS Start-End: 160-568
ttttccaaatacactcacagtatcagaatacaactgtttccttttctccgaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatg

SEQ ID NO: 193063 - DNA, 577 bp, Homo sapiens
  Payload ID: 18119
  Gene Name: transmembrane 7 superfamily member 3
  ENST ID: ENST00000543803
  CDS Start-End: 192-577
ctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggt

SEQ ID NO: 193064 - DNA, 244 bp, Homo sapiens
  Payload ID: 18119
  Gene Name: transmembrane 7 superfamily member 3
  ENST ID: ENST00000537406
  CDS Start-End: 1-244
ttttatatactgattacaagactgacacctatcaagtatgatggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactca

SEQ ID NO: 193065 - DNA, 601 bp, Homo sapiens
  Payload ID: 18119
  Gene Name: transmembrane 7 superfamily member 3
  ENST ID: ENST00000543088
  CDS Start-End: 402-601
gtgacgcagcgagagcccgggaggaggcgcgggaacgcgcgttgggggtcaggtgccggaagaggaaacctctcgctggggctaggagttcggcggggcgcgcgccggcggctgcggagctggcaggtcttattgaattttctgtggggaaatttagatacttcgagctcaataggccctttccagaggaagctattttgcatgatatttcaagcaatgtgacttttcttattttccaaatacactcacagtatcagaatacaactgtttccttttctccgactctcctttccaattcctcggaaacaggcactgccagtggactggttttcatccttagaccagagcagagtacatgcacttggtacttggggacttcaggcatacagcctgtccagaatatggctatcctactctcctactcagaaagagatcctgtccctggaggctgtaatttggagttcgatttagatattgatcccaacatttacttggagtataatttctttgaaacgactatcaagtttgccccagcaaacctaggctatgcgagaggcgtagatcccccaccatgtgacgctgggacagaccaggactccag

SEQ ID NO: 193066 - DNA, 788 bp, Homo sapiens
  Payload ID: 18119
  Gene Name: transmembrane 7 superfamily member 3
  ENST ID: ENST00000535819
  CDS Start-End: 380-788
gttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagctgctggtcgtagcggtgctggcatccgaacaccgggtggctggtgcagccgaggtcttcgggaattccagcgaggaggcgtagatcccccaccatgtgacgctgggacagaccaggactccaggtggaggttgcagtatgatgtctatcagtattttctgcctgagaatgacctcactgaggagatgttgctgaagcatctgcagaggatggtcagtgtgccccaggtgaaggccagtgctctcaaggtggttaccctaacagctaatgataagacaagtgtttccttctcctccctcccgggacaaggtgtcatatacaatgtcattgtttgggacccgtttctaaatacatctgctgcctacattcctgctcacacatacgcttgcagctttgaggcaggagagggtagttgtgcttccctaggaagagtgtcttccaaagtgttcttcactctttttgccctgcttggtttcttcatttgtttctttggacacagattctggaaaacagaattattcttcataggctttatcatcatgggattcttcttttatatactgattacaagactgacacctatcaagtatgatg

SEQ ID NO: 193067 - DNA, 666 bp, Homo sapiens
  Payload ID: 18119
  Gene Name: transmembrane 7 superfamily member 3
  ENST ID: ENST00000545344
  CDS Start-End: 1-666
gtttgggacccgtttctaaatacatctgctgcctacattcctgctcacacatacgcttgcagctttgaggcaggagagggtagttgtgcttccctagaattattcttcataggctttatcatcatgggattcttcttttatatactgattacaagactgacacctatcaagtatgatgtgaatctgattctgacagctgtcactggaagcgtcggtggaatgttcttggtagctgtgtggtggcgatttggaatcctctcgatctgcatgctctgtgttggactagtgctggggttcctcatctcgtcagtgactttctttactccactgggaaacctaaagatttttcatgatgatggtgtattctgggtcactttctcttgcatagctatcctcattccagtagttttcatgggctgcctaagaatactgaacatactgacttgtggagtcattggctcctattcggtggttttagccattgacagttactggtccacaagcctttcctacatcactttgaacgtactcaagagagcgctcaacaaggatttccacagagctttcacaaatgtgccttttcaaactaatgacttcattatcctggcagtatggggcatgctggctgtaagtggaattacgttacagattcgaagagagagagga

SEQ ID NO: 193068 - DNA, 2452 bp, Homo sapiens
  Payload ID: 18120
  Gene Name: transmembrane 9 superfamily member 1
  Uniprot ID: O15321
  ENST ID: ENST00000261789
  CDS Start-End: 360-2180
gacgtgtcctgggccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggctca

SEQ ID NO: 193069 - DNA, 2055 bp, Homo sapiens
  Payload ID: 18120
  Gene Name: transmembrane 9 superfamily member 1
  Uniprot ID: O15321
  ENST ID: ENST00000396854
  CDS Start-End: 291-1760
cgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcaggtatcctccctttattccatggctattactgtcaggttcctgacctcaatttttcctgtccctactcatccagtaccctaacccaacccgttgatccctggttcagtggtaccattcagagatcattaaatggttcctcctatccccaagcaggactgagcttgaatgatatgagagtgtctcacttataaagctctccggagacatttcccccttcaccttcctggtttctgactttaatgcctatggacatcatgtggggtttaaagcccatttgatgacccatttactttgttgaatacctctttgtgccaggcaaagaataaagtggaataaaa

SEQ ID NO: 193070 - DNA, 961 bp, Homo sapiens
  Payload ID: 18120
  Gene Name: transmembrane 9 superfamily member 1
  ENST ID: ENST00000528895
  CDS Start-End: 60-961
gcgcggtgaggaccccggggctgtggcgggaagggacccgaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccc

SEQ ID NO: 193071 - DNA, 2107 bp, Homo sapiens
  Payload ID: 18120
  Gene Name: transmembrane 9 superfamily member 1
  ENST ID: ENST00000529332
  CDS Start-End: 126-1388
caacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctga

SEQ ID NO: 193072 - DNA, 882 bp, Homo sapiens
  Payload ID: 18120
  Gene Name: transmembrane 9 superfamily member 1
  ENST ID: ENST00000525592
  CDS Start-End: 156-882
gacgtgtcctgggccgcgctgccgatcgccgggaggacccccgcctcgccgaagacgggcggggcaagccgagcctcacggggtccccggagctgggccgggcctccagatggagaaggcgcaacggggagttcttgagttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactcca

SEQ ID NO: 193073 - DNA, 2425 bp, Homo sapiens
  Payload ID: 18120
  Gene Name: transmembrane 9 superfamily member 1
  ENST ID: ENST00000528669
  CDS Start-End: 390-2159
cccaaaggcagctacgggggcgcgaaggccgctggcgccgcctcggccagcccttcccgcgcggtgaggaccccggggctgtggcgggaagggacccgaggtgcgagaccgagcggcgttgccatggaaacgggccagggcgcgtagtagaggccccgggccagacgggctgcgggtggggtgaaccccaggttgggaggatgagagagcagaggtggagcggggtctttgggatagagagacgtggggtagggtgaggcggggagggggccaatgggagcaagtggagccaggggacctcagttcgaggcacctgacctggggtttctgtaacctccctggtttctataacctcaggattcccccaaacaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctgtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaa

SEQ ID NO: 193074 - DNA, 904 bp, Homo sapiens
  Payload ID: 18120
  Gene Name: transmembrane 9 superfamily member 1
  ENST ID: ENST00000528010
  CDS Start-End: 275-904
ggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggattcccccaaacaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgag

SEQ ID NO: 193075 - DNA, 1938 bp, Homo sapiens
  Payload ID: 18120
  Gene Name: transmembrane 9 superfamily member 1
  ENST ID: ENST00000524835
  CDS Start-End: 365-1924
gaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcgcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcag

SEQ ID NO: 193076 - DNA, 1065 bp, Homo sapiens
  Payload ID: 18120
  Gene Name: transmembrane 9 superfamily member 1
  ENST ID: ENST00000530468
  CDS Start-End: 294-1065
ctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtgaggaccccggggctgtggcgggaagggacccgaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaa

SEQ ID NO: 193077 - DNA, 505 bp, Homo sapiens
  Payload ID: 18120
  Gene Name: transmembrane 9 superfamily member 1
  ENST ID: ENST00000532632
  CDS Start-End: 105-505
cagcaggagcccaaaggcagctacgggggcgcgaaggccgctggcgccgcctcggccagcccttcccgcgcggattcccccaaacaggttccactgccttaaggatgacagtcgtagggaaccctcgaagttggagctgccagtggttgccaatcctgatactgttgctgggcacagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacag

SEQ ID NO: 193078 - DNA, 721 bp, Homo sapiens
  Payload ID: 18120
  Gene Name: transmembrane 9 superfamily member 1
  ENST ID: ENST00000530563
  CDS Start-End: 99-721
ggggctgtggcgggaagggacccgagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatac

SEQ ID NO: 193079 - DNA, 3430 bp, Homo sapiens
  Payload ID: 18121
  Gene Name: transmembrane 9 superfamily member 2
  Uniprot ID: Q99805
  ENST ID: ENST00000376387
  CDS Start-End: 191-2182
gcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcggtctgcttgtatctgtgagcatattcatttgtattttagggtctctctgcttgctgcttaggagagcaaatcagatactgtcattaaacttacaactaaaatta

SEQ ID NO: 193080 - DNA, 6141 bp, Homo sapiens
  Payload ID: 18122
  Gene Name: transmembrane 9 superfamily member 3
  Uniprot ID: Q9HD45
  ENST ID: ENST00000371142
  CDS Start-End: 218-1987
gaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatctattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgtac

SEQ ID NO: 193081 - DNA, 868 bp, Homo sapiens
  Payload ID: 18122
  Gene Name: transmembrane 9 superfamily member 3
  ENST ID: ENST00000443638
  CDS Start-End: 108-868
cgtgattcattcacagcggcagacgagcgccaggaaagggttatttgatctgatccctcaagttccggaggcagcagtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctgg

SEQ ID NO: 193082 - DNA, 4032 bp, Homo sapiens
  Payload ID: 18123
  Gene Name: transmembrane 9 superfamily protein member 4
  ENST ID: ENST00000217315
  CDS Start-End: 341-2218
ccaagatggcgacggcgatggtgagtgaaggagactccgggagcgggagctggagcggggccctccggggtatcccaggatcttccagcaccccatgcctggccctgagccacctccgggacccctgactcaggcctgagggctacctctgactgggcttgtcttccccgaaatccacctccctggccctgcccctgcactcaggcttgtgaaggccccgagttttgggggaggcgccgtttcggaggaagacctcggctgctgccttcgccggttcccattctacttttggtctccgcccactgattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctactg

SEQ ID NO: 193083 - DNA, 3978 bp, Homo sapiens
  Payload ID: 18123
  Gene Name: transmembrane 9 superfamily protein member 4
  Uniprot ID: Q92544
  ENST ID: ENST00000398022
  CDS Start-End: 236-2164
agtttctgccaggagctaatatggcttccttagttacaccgttctctctcttcacctaatcagcgaccttactttcccagaccagactgtcgagcaggagctaagactccttttcccctctgctgaccgccactacaggagcggttgaagccagacgaccaccttgtggagttaaactccgtaaccagggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctactg

SEQ ID NO: 193084 - DNA, 550 bp, Homo sapiens
  Payload ID: 18123
  Gene Name: transmembrane 9 superfamily protein member 4
  ENST ID: ENST00000450829
  CDS Start-End: 14-271
acgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggaaggagaaaggagagaactggttcttgagcaagcccctgaaagggctgccttctccgtcagggctacgcatggctcagatgtttctggaacctctagctgacaaatttatctactgccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatg

SEQ ID NO: 193085 - DNA, 553 bp, Homo sapiens
  Payload ID: 18123
  Gene Name: transmembrane 9 superfamily protein member 4
  ENST ID: ENST00000417389
  CDS Start-End: 310-516
agactccgggagcgggagctggagcggggccctccggggtatcccaggatcttccagcaccccatgcctggccctgagccacctccgggacccctgactcaggcctgagggctacctctgactgggcttgtcttccccgaaatccacctccctggccctgcccctgcactcaggcttgtgaaggccccgagttttgggggaggcgccgtttcggaggaagacctcggctgctgccttcgccggttcccattctacttttggtctccgcccactgattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggttctcatgaacagcgagaagaagtgtgaagttctgtgcagccagtccaacaagccagtgaccctg

SEQ ID NO: 193086 - DNA, 563 bp, Homo sapiens
  Payload ID: 18123
  Gene Name: transmembrane 9 superfamily protein member 4
  ENST ID: ENST00000442842
  CDS Start-End: 25-282
attacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggaaggagaaaggagagaactggttcttgagcaagcccctgaaagggctgccttctccgtcagggctacgcatggctcagatgtttctggaacctctagctgacaaatttatctactgccaggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctg

SEQ ID NO: 193087 - DNA, 5992 bp, Homo sapiens
  Payload ID: 18124
  Gene Name: transmembrane and coiled-coil domain family 1
  Uniprot ID: O94876
  ENST ID: ENST00000393238
  CDS Start-End: 342-2303
gacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggagcttttcctaaaaggattgtacaccttagaagtgcttaaggaagagtgatgaagataggcatgaagccttcgtctcacagctgcatgcgtagtcactgttgaagcaaatgcctacctaatttgacactcttggtgtgtttaaaaaatttttttgagtttgcaaataagcatattaagtctactgatggagccttcgggcagtgaacagttatttgaggaccctgatcctggaggcaaatcccaagatgcagaggccagaaagcagacagaatcagaacaaaaattgtctaaaatgacccacaatgctttggagaacattaacgtgattggccaaggcttgaagcatctcttccagcaccagcgcaggaggtcatcagtgtctccacatgatgtgcagcaaattcaggcagatccagaacctgaaatggatctggaaagccagaacgcatgtgctgagattgatggtgtccccacccaccccacagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccagctctgctatgatggaaatagcttgtgctgctgctgctgctgctgctgcatgtctaccaggagaggagggaactgcggagcggatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccccgtcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcaactaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaa

SEQ ID NO: 193088 - DNA, 5484 bp, Homo sapiens
  Payload ID: 18124
  Gene Name: transmembrane and coiled-coil domain family 1
  ENST ID: ENST00000426664
  CDS Start-End: 178-1797
ggcggccgcagtggaaggagcaggcgcttgagctcgagcgacggcgctggcggagacgccggctgctcctcccctccccgccgcttttcctaaaaggattgtacaccttagaagtgcttaaggaagagtgatgaagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccagctctgctatgatggaaatagcttgtgctgctgctgctgctgctgctgcatgtctaccaggagaggagggaactgcggagcggatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccccgtcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcaactaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctatt

SEQ ID NO: 193089 - DNA, 5631 bp, Homo sapiens
  Payload ID: 18124
  Gene Name: transmembrane and coiled-coil domain family 1
  ENST ID: ENST00000432054
  CDS Start-End: 953-1942
tttgcattagctgctctagcaaactgcgtgcgcgcgcacacacacggatgcttgtttggcagaagctttctgtttattcagcacagagttctcctaggctcccagatatagaaagctctaagagttgctacaggagatagaattgaaactatacataggctgaggtgggcactgcggaggattggctatgcgagggtattaatgtggtgcggctgtacctgcctgttttgtgaaagtcacttctctgagactgtgaaggtgagaagcccagggatccactagaagcttcactgcggctctttggtgggggaaagcattcccagtggtagctgtcctcatttgcagcgttattctcggaaaccaagtatgtgcagcagtgacagactatgccacagctcctctgcagtttggaagctggaacaaatggaaagagcttatagccaagagaggttgtgatttttttttttttaccatccaagctttctctggcagtgcacaaatgaaggatgagctttgtggcaagcaaaatcagcagactgcctgacagggggttttgatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccccgtcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcaactaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaa

SEQ ID NO: 193090 - DNA, 402 bp, Homo sapiens
  Payload ID: 18124
  Gene Name: transmembrane and coiled-coil domain family 1
  ENST ID: ENST00000505616
  CDS Start-End: 153-402
gcttgagctcgagcgacggcgctggcggagacgccggctgctcctcccctccccgccgcttttcctaaaaggattgtacaccttagaagtgcttaaggaagagtgatgaagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccagctctgctatgatggaaatagcttgtgctgctgctgctgctgctgctgcatgtctaccaggagaggagggaactgcggagcggatcgaacggttggaag

SEQ ID NO: 193091 - DNA, 208 bp, Homo sapiens
  Payload ID: 18124
  Gene Name: transmembrane and coiled-coil domain family 1
  ENST ID: ENST00000510323
  CDS Start-End: 157-208
agaaggcagtatagagactcctatcaaggataaagaagaactaaatagagtttagtaacatcgtaaaaaggatgtgaacgattggaagaacagctaaatgacctaacagagctccaccagaatgaaatcttgaacttgaagcaggaactggcaagcatggaagaaaaaatcgcgtatcagtcctatgaacgggcccgggacatccagg

SEQ ID NO: 193092 - DNA, 203 bp, Homo sapiens
  Payload ID: 18124
  Gene Name: transmembrane and coiled-coil domain family 1
  ENST ID: ENST00000513411
  CDS Start-End: 186-203
aggtaggatgaattggacaaggatgagactcgtgtaggtgaggacagttggaaggatcatgatgtcgtaatcttggagttaggtgaaacagcttttcctaaaaggattgtacaccttagaagtgcttaaggaagagtgatgaagctctgaatcgtgtcctgcagcagattcgagtgccacccaagatgaagagagggacaagc

SEQ ID NO: 193093 - DNA, 2818 bp, Homo sapiens
  Payload ID: 18125
  Gene Name: transmembrane and coiled-coil domain family 2
  ENST ID: ENST00000329800
  CDS Start-End: 190-1599
aagtgggtgcagaatccatgtctttctgaacgacagttctgctgtgagaagctgccattagagagatccagcaggccccaggactcagctggccagccggtgacactgctcactgctcattgtcctcagctgtggacctctgtccccctctgctggccactcacagaatttcctgctggcactgtcaagatgaagtccaaggaggaagagactgctgtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacca

SEQ ID NO: 193094 - DNA, 2674 bp, Homo sapiens
  Payload ID: 18125
  Gene Name: transmembrane and coiled-coil domain family 2
  ENST ID: ENST00000330675
  CDS Start-End: 1-1455
atgaaccaggttgttcagcccttaatgagcagacactctgcatgtagaggcagccaggcccacctctcatgggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacca

SEQ ID NO: 193095 - DNA, 3738 bp, Homo sapiens
  Payload ID: 18125
  Gene Name: transmembrane and coiled-coil domain family 2
  Uniprot ID: O75069
  ENST ID: ENST00000358024
  CDS Start-End: 390-2519
ggccggccgggagggatgcgctgtgccgcccagctcctctccgtcctgcccatgccctgaagcagaaagtttgggggccgggggttgtctcccttctccctcctgcaatgactgcccaaggactcttgctgcccagcctcgactgtgacctgtcttcgctccccaggtcgaaatgaactattccaagctataaccaaggctcccccttctcgcccctccctcacccgcctttaagaattttttttttaattcaagaaattgtggtctgccatctcccctccttgttaataatttagaccccaggcctcatatgaatataagagggggtgcggtcttccccaagacggcgcgctggaaggacagattccccttgccgacccacatacaccatgaagaggtgcagatcggacgagctgcagcaacaacagggcgaggaggatggagctgggctggaagatgccgcttcccacctgccgggcgcggacctccggcctggggagaccacgggtgctaactctgctggcgggccaacttcagacgccggcgctgccgcggcgcccaacccaggtccccgaagcaagcctcctgatttaaagaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacca

SEQ ID NO: 193096 - DNA, 892 bp, Homo sapiens
  Payload ID: 18125
  Gene Name: transmembrane and coiled-coil domain family 2
  ENST ID: ENST00000367159
  CDS Start-End: 125-892
tgaaccatttgcaagcctagcctccactggggagaagtctgttctcagagtgaggagctctgcacgcgttggctaaaagggtggcgtggctttgtgaaattgagagctggaggagcccagcagaatgaaccaggttgttcagcccttaatgagcagacactctgcatgtagaggcagccaggcccacctctcatggctgtggacctctgtccccctctgctggccactcacagaatttcctgctggcactgtcaagatgaagtccaaggaggaagagactgctgtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatggg

SEQ ID NO: 193097 - DNA, 3339 bp, Homo sapiens
  Payload ID: 18125
  Gene Name: transmembrane and coiled-coil domain family 2
  Uniprot ID: O75069
  ENST ID: ENST00000545499
  CDS Start-End: 226-2121
accatttatgcctctgtctttcagctccgtgtcaggtctctgtgtttgttccccattattcagcaagcgttttagtgactcacccatccgagattgtttgaataatgtgtgaagtgttattcgcagacaaagggctggagaaatccaagatgctaaccaaaaagtggacagcaggtgaccattagttttccttgctgaaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacc

SEQ ID NO: 193098 - DNA, 5877 bp, Homo sapiens
  Payload ID: 18126
  Gene Name: transmembrane and coiled-coil domain family 3
  Uniprot ID: Q9ULS5
  ENST ID: ENST00000261226
  CDS Start-End: 133-1566
gcaccagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcgtaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcagcatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaagaatcacaggcttgggcagtgttaaacactgtggcctatggtccccgtgtgatccaccctgcttctctccaggggaccataggtcccgtcatgtactcagtgtccacagcagtcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatggaaatccataatgaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaatttt

SEQ ID NO: 193099 - DNA, 4361 bp, Homo sapiens
  Payload ID: 18126
  Gene Name: transmembrane and coiled-coil domain family 3
  ENST ID: ENST00000551457
  CDS Start-End: 155-1495
ccaaagtccaggctgagtcatatggtaggtgctgtttggaatatctagcctgcctgccttgcagattcaaatgcctcgggcaggagggtgagctagctgccgatcctgctctgctcctgggtttgctgtgtggcccttggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcagcatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaagaatcacaggcttgggcagtgttaaacactgtggcctatggtccccgtgtgatccaccctgcttctctccaggggaccataggtcccgtcatgtactcagtgtccacagcagtcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgt

SEQ ID NO: 193100 - DNA, 483 bp, Homo sapiens
  Payload ID: 18126
  Gene Name: transmembrane and coiled-coil domain family 3
  ENST ID: ENST00000548918
  CDS Start-End: 87-483
tttgctctgccttcatcacattggtgtttactgtgcccagtccactgctggcatttgctctgcctaacaaggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatac

SEQ ID NO: 193101 - DNA, 2224 bp, Homo sapiens
  Payload ID: 18127
  Gene Name: transmembrane and coiled-coil domains 1
  ENST ID: ENST00000367881
  CDS Start-End: 277-996
ctaatattacgaccacagaagttgggctgaggtagaagtcaagactatcccaataactggattctggccgagaaaaaggcgcgcgccagcaccccagtcagtaaaatctaccgggcaaagttcgccgccgccactatcctcctctggctctgaaatagttccaattctcgcgagattcggcctgactaccagcccttcagctccagtgagttgcgggttggtttcctctagactctcgtggccacaccgttctccgatacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaatgagggtcctcagctgttctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattgttaaaccaacagcaaacttctttcttatcagcaccataaagtccagaagacagtagaaaagtatcttcaaagtgctgaggaaaataagtatcaacttagaattttatgtacaatattggaggcaaaataaagacatgtttagacatacaaaa

SEQ ID NO: 193102 - DNA, 1946 bp, Homo sapiens
  Payload ID: 18127
  Gene Name: transmembrane and coiled-coil domains 1
  Uniprot ID: Q9UM00
  ENST ID: ENST00000392129
  CDS Start-End: 152-718
gccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaatgagggtcctcagctgttctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattgttaaaccaacagcaaacttctttcttatcagcaccataaagtccagaagacagtagaaaagtatcttcaaagtgctgaggaaaataagtatcaacttagaattttatgtacaatattggaggcaaaataaagacatgtttagacatacaaaa

SEQ ID NO: 193103 - DNA, 752 bp, Homo sapiens
  Payload ID: 18127
  Gene Name: transmembrane and coiled-coil domains 1
  ENST ID: ENST00000481278
  CDS Start-End: 323-752
tctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggtgagagcgggtatttctcagacgtttgatcagtccccgggaggaagggccccggggtcccctgtgccaccaggggaaagatcgcgagccttacttgcttgagaggctcatctactccacttcagggaatctctgggcaactcgtgaacaggagcaggaggggagtatggagtcgattgccgagttttctttggtctcaggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgac

SEQ ID NO: 193104 - DNA, 1735 bp, Homo sapiens
  Payload ID: 18127
  Gene Name: transmembrane and coiled-coil domains 1
  ENST ID: ENST00000580248
  CDS Start-End: 704-1018
gctttccgcagccgccgctgggcgctgccggggctgaggccgctgtcgctcgcctgcgagccgctcggagcccggtgacggggctgggtttcccgaaggagccaagagccttcctttgcccgcagcggctggtccggtttacatcccaggcagaggtcagcgtgatgctgctgctccaatccgggcgggcagcgcgctgctattcgccgaggcggaggcggcgaggcgtctggccccagcctccgcccctcccgggccccgccgccgcccgaggtctctgcgaaagggtctcactctatccaataggctggaatgcagtagcatgatcaccacttactgacgctttgacctcccagtctcaagcaatcctcccacttcagcctttcgagtagctgagactacagagtcttgctttgtcaccaggctggaatgcagtggcgcaatcttggctcactacaacctccacctcccggtttcaagcgattcttgtgcctcagcctcctgagtagctgggattacaggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctg

SEQ ID NO: 193105 - DNA, 760 bp, Homo sapiens
  Payload ID: 18127
  Gene Name: transmembrane and coiled-coil domains 1
  ENST ID: ENST00000465705
  CDS Start-End: 15-473
gcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagacagagtctcaccctatcgcccaggctggagcacagtgacgcgttcatggcccactgcagcctcaaactcctgggctcaagtaatcctcccactgtagcctcccaagtagctgggactacaggggcacaccatcacgagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatg

SEQ ID NO: 193106 - DNA, 1100 bp, Homo sapiens
  Payload ID: 18127
  Gene Name: transmembrane and coiled-coil domains 1
  ENST ID: ENST00000464650
  CDS Start-End: 301-615
gggctgtcagagttggtctgttactcggtggtggcggagtctacggaagccgttttcgcttcacttttcctggctgtagagcgctttccccctggcgggtgagagtgcagagacgaaggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaa

SEQ ID NO: 193107 - DNA, 581 bp, Homo sapiens
  Payload ID: 18127
  Gene Name: transmembrane and coiled-coil domains 1
  ENST ID: ENST00000476143
  CDS Start-End: 1-287
agtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaatagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacga

SEQ ID NO: 193108 - DNA, 4468 bp, Homo sapiens
  Payload ID: 18127
  Gene Name: transmembrane and coiled-coil domains 1
  ENST ID: ENST00000612311
  CDS Start-End: 19-738
acgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagagagacaagaagagaaactgaagaataacaacagagatctatcaatggttcgaatgaaatccatgtttgctattggcttttgttttactgccctaatgggaatgttcaattccatatttgatggtagagtggtggcaaagcttccttttacccctctttcttacatccaaggactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaatgagggtcctcagctgttctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattgttaaaccaacagcaaacttctttcttatcagcaccataaagtccagaagacagtagaaaagtatcttcaaagtgctgaggaaaataagtatcaacttagaattttatgtacaatattggaggcaaaataaagacatgtttagacatacaaaactaagagagttgaattattaaaggttatattccaaggacaaaaaagaggatctgcccaaggtgaaggtatggcatacaagaaacaatggtcaacagagaaataaaatatatggatgaatatatggataaatttgagtgttttatggattatctaatttaaggattatcccaagacagccctacaaggtaattactgttcttaccttcatttaacagatgaggaaactggggcaggggaggttagtaacttgctctgcatcacagagctattgagtggcagtcaggatttgaattcaaccagtgtaaagcctaatagtccaggctgtcaagctctatattacagcctcctcatgggtatgtggtgattctcttctcatcccatctcctcaactagagtgtgtgagctctctaaagttggactttgtctttttttttgttctccttattacaaagtagtcaacgtgggtggaaacacagcaggagctcaataaaagcagatgaaagggaacagaagtccctattctgagactagttttatcagaaggatgtctgataatggatggtaatgacttttaatggtcttttctccatatcattgaccactctaagcaaaataataattcgaatgataatgaagaaaatgatgcccatgataacaataatgacaaatatgaaatggctaaaataaaacatgaaaccatcctcaaaattctgccatcacctttttaaagtgagaatatatagcacactctatcactcataccctgaggctttgaagttggtgctttctaatcagacttcttatggaccaggttttcatatacaaattatgtttccatggtaaggaataaataagagggagaagttaaaaaggagagattacatctattcaccctattcattaaaatttttttaaatttttttccaaatatgttctgcttatgtatattcactctattcttaaaagcacaataacaaagatatattacagaggaaataaaactatcacaagaattaaattcaaggagttattaagggctactgcagcctcacaattagttttttaaaatttcttgtcctgaagaaatttcaagactagttatttggatgacactctaggtccacagcatcaccagatcattggagatgacatttcaagacaggcctctgaacatctctcataacacataatttggttattttccctatgtaagatggattgtctcctgtctagggaagaaaaacagccattactaatatctgcattagtctactcaggttgcaatcataatatgctaaagtagtaaacttttaaaaatgacagtaaacctgagtttattaacaggttacattctaaaagctaagctagtttggaaattggaaagcaaatgtgtgtagatattcatatgtccttgaccagactgggcctttctcttcccaggtaagtcattctctccaatggggccagttacttaaaattacatcagacaattgatagagcttctagatcccccttctaaaacaaaagcattttgccacaaactaggatggagtaggtttttttcagactatttatacttattttatgtatttcaatactgccctttaagtaaaagtactatatactttctctttttttagattaattctgcttaagtcagtcttttaatttattctagtttgagtttttaaaaaattttagaatgaaaaatctcaaaaatatactattatgtatatacactattttatatatatatatatatatatatagagagagagagagagagagagagagagagagagagagaaagagagaataaagaacacctaggtaacccatcctccaccttcgacaattatcagctcctagctaatttgtgtcatctgtaaccccacctgcttctgccctttctgtattattttgaagcaaatcttatcatttatctgtaaatatttcaggactttaaaaaatatgtgtaatctgaataccatttttacacctaagaaaatggacaattccttaatataatgtgttgtctatagatgtcaaaaatttttgcagttttttggaatcaggaaccaagtaaggtactgaatattgcagttagctgatacacatcctaaatttcttcaattgttgtggtcctcaaactagagtgtatcagaatcactagagccttgttagaacacaaactgctgggccccaccccagagctggtgatctgtaagtctgctgtggagtctgggaatttgcatctctaacaaattcccaggtgatgctgaagctgcaggtttggggttcactcacctattggttcatcagcatctctctgccctcttacaatatatttgttgaagaagttgtgttgtttaccttgtagagtttttcttagtttggattttggtgatagcatgctggttttttcatactattggttgtctctgtaatgcgagcagcttttgatctattaattaatgagatattaaaagtgatggtattct

SEQ ID NO: 193109 - DNA, 477 bp, Homo sapiens
  Payload ID: 18127
  Gene Name: transmembrane and coiled-coil domains 1
  ENST ID: ENST00000628579
  CDS Start-End: 19-477
acgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaattggaaaagaagaaggaaacaataacagagtcagctggtcgacaacagaaaaagaaaatagacagagtctcaccctatcgcccaggctggagcacagtgacgcgttcatggcccactgcagcctcaaactcctgggctcaagtaatcctcccactgtag

SEQ ID NO: 193110 - DNA, 739 bp, Homo sapiens
  Payload ID: 18128
  Gene Name: transmembrane and coiled-coil domains 2
  Uniprot ID: Q7Z6W1
  ENST ID: ENST00000372766
  CDS Start-End: 94-642
ggaatacctaggcctccagactactccccctaactcatatttagattcctgaagcttctgcacatgtagttcctagagctgctgcttattaaaatgtcaacatcttcatcttctagctgggacaacctcttagagtctctctctctcagcacagtatggaattggatacaagcaagttttttgggagagactagtgcacctcagcaaacaagtttgggactattagataatcttgctccagctgtgcaaatcatcttgaggatttctttcttgattttattgggaataggaatatatgccttatggaaacgaagtattcagtcaattcagaaaacattgttgtttgtaatcacactctacaaactttacaagaagggctcacatatttttgaggctttgctagccaacccagaaggaagtggtctccgaattcaagacaataataatcttttcctgtccttgggtctgcaagagaaaattttgaaaaaacttaagacagtggaaaacaaaatgaagaacctagaagggataatcgttgctcaaaaacctgccacgaagagggattgctcctctgagccctactgcagctgctctgactgccagagtcccttgtccacatcagggtttacttcccccatttgaaatgtgatggactccaatcttttccaggaaagcactgtttccctcatgtgtgcagtggtgtatcaataaagatagagaacgctattgaaattaccgt

SEQ ID NO: 193111 - DNA, 2132 bp, Homo sapiens
  Payload ID: 18129
  Gene Name: transmembrane and coiled-coil domains 3
  Uniprot ID: Q6UWJ1
  ENST ID: ENST00000375391
  CDS Start-End: 312-1556
gagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataattaattgaaatttattaaaatctgtttttattaa

SEQ ID NO: 193112 - DNA, 3050 bp, Homo sapiens
  Payload ID: 18129
  Gene Name: transmembrane and coiled-coil domains 3
  Uniprot ID: Q6UWJ1
  ENST ID: ENST00000434316
  CDS Start-End: 360-2393
aaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataa

SEQ ID NO: 193113 - DNA, 459 bp, Homo sapiens
  Payload ID: 18129
  Gene Name: transmembrane and coiled-coil domains 3
  ENST ID: ENST00000473287
  CDS Start-End: 1-437
aaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtaagcgttccagaacagctgcttcttcacctcctgagccactcactaatcagaagacatgttgttgaaattgttcacgtgtatgtttttaatgtagattgaaaatgaagacaaactaaaatgc

SEQ ID NO: 193114 - DNA, 3542 bp, Homo sapiens
  Payload ID: 18129
  Gene Name: transmembrane and coiled-coil domains 3
  ENST ID: ENST00000620021
  CDS Start-End: 1-285
tttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggcctcacctcccaacgcttgcagtgcacatcgaggggacagaagcatttgaaccgtagcaggcattcaggatacagtggagtctctgcaacagggtgactttttttttgtctccaacacctgtgaccatctttttaattttgttaaactgaaggaaaccgacttgatgagagtaacatcaaactccccccaaaacacgaaattagcctctctctgcaagatgaaataagaagtgccctgaatgacgagagaaagcatgctagggtctctgcctaactgatcactcaggtaagatcctaactgcccaggaacggtgtcctcaaagccccagctgggcccacctgccccactccagccacaggacctggctctgtgaacccgtcactcccgttttcacccccacctctctgctagtgacttcctcatctgtgacctgcccgtttgtcccatgctgacccagcagaaccctttcttgacctcatgactcctctttcatccagaccttccagaaagcttcaccctccccatcccatccccatcatgtctgcccctgtcatccagatgggggtctccgagccaccgagcccctggtagccacattgcccccaccctgctctcagcatttccccagtgtgtagcatgtcactagaaagaagtgggaggacggactcatggtgagtcttgtggggacatgtttgctggaggctaaccagcctgatcatgacatcttcatcttaaatttgaaaattgtcatcaggttacggtgaaatcctaccggatcaacatctgagaccaggcttatggaagtgagcttccaacctgaatgcttgaggctgagggggtgttggcggcctcgataacaacctgaacaacagctggcagcagggagtgcctgggccatgtgtccccagagcactgacctgggtggtccagtctcctgtctcgagctccagccatgagcttacacggccttcacactccccccaaaaccagccattctcaaccagcgaggcctctgtgtctgcaaggccagttttatttcttctttgatatttctgcttctgtgtcctttccccgctgcccaaaagctgcctcccgtctgcccatgcagagctgtattacccaacaacacccagctcgactcggacagcacccagctcaactcggacaggccccgggaaagtaagagcttggggggagacccacaggcccacacggcagcactgcgaggctagaccgtaaacatgggtcaattgaatatttataaacaggatacttaaaggttcttgggatattgaacaatgaaagaaattgtactatttgaaaattctatttcacatgaaaatgtaaaatttcagcatatcagaaagcatcgtgaacaaatttgaaagccaagcaaaactgggaaaaatatttggataaaaaaatcctaacactggtacataatacataataggcagttcatatgtattttttgtatgaatgaaacttacaatacttttattaatgtcatgggaacttataaaaactgcatggagatattttaaagaaaaaattttgaaacccattttggttttctttataattccttcagttcagcccattcctgtaaccacgtgctcatccccacaggactaggcagtgcccacccttggtgccctgcagtgcaccgcaaggacatggccgtggcctggagccgcgtccctgagttcctggtgggccgcgtgagtctccctgttcctccctgctgccttctcctctcctggcttccccaccccatacttccctgatgatatggtttggctgtgtccccacccaaatctcattttgaattgtaatcgtcatgggttgaccgagggaggtgattggatcatgggggcagatgtcccccaggctgttctcatgatagtgagttctcacaaggtctgacggttttaaaagtggcagtttgttctcgcgctctcgcttctccatcctgctgccttgtgaataaggatgtgtctgcttccccttctgccgtgattgtgtttcctgaggtctccccagccatggagaactgcaagtcaattaaacctgtttcctttataaattacccagtcttggggaaggcgtgagaacagacaaacatgcctgagtccccgagtctgtgatgctcctcattcttcagcacggcctgtgcccgggacggggcgctcctccagtgcagagctcacaccatgactgtggtgtccttcaaataacactgctgctgccagcttcccagggactcttctcctgtgtgattccagtgccttgcctatgtccctgctaatcttctggagtttaggggtccgtgcgaagcccaccccacctgagtcctttcatcctgggtgccttcacctccgtccaggactccggggttgcagccacacatgctcatgtcaccgtgaggcccagccctccagggcctgagatgtacagatgctatccccctgggcacccagtgtttccccttcctccctgtctgccttttgctcaatctctcagcgccctcaggaagccctttcacagctcagcagggaaacctctgggctcctccccctccagcaagtcacctggaagctctcaggctggccatggaaagctgaacccactgccaggggactggacagagaggctggtctcattttccaatcccttccagaaggaaggaggatgcttctcctgagagcagcgacaggtttgtgtcctgtgacctctgccttccctcgcccgggggagggtgatggggcgtctttttggctttggtttaagtagcaaaagagatggagtgttcaaaggattgaggggtcggccgagggtggggcttctcagtgaggggcgggtcctctgggcgtcatgagggcctggggagaggaccctgacccactgccagggagctgtgccagaggttcccatgggacatggaaggggaaccgacatccgtttctgcactggggtgtggacacctggccccacaccacctaggttcccccacaggggcctgaagactggaggttctctccagaatgttctggtttgattctgagagcaggagagacacccataaaaatgattggggttaaatttctggccaggtagatgggaactcacagccaaaatttaattaaggagaataaacaattgtgccacgccatgcatccaagtccggcagggcaaatccacacccgctactcactgagcttcccctgggccggaatgctccccctacatttgcaagaacaaagcctccttcctgtagaaaagaaaacaaaagtaaaataaaaaagaacaaagc

SEQ ID NO: 193115 - DNA, 491 bp, Homo sapiens
  Payload ID: 18129
  Gene Name: transmembrane and coiled-coil domains 3
  ENST ID: ENST00000462877
  CDS Start-End: 1-491
aatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgca

SEQ ID NO: 193116 - DNA, 2822 bp, Homo sapiens
  Payload ID: 18129
  Gene Name: transmembrane and coiled-coil domains 3
  ENST ID: ENST00000622371
  CDS Start-End: 1-381
ataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtaaggacctcatcaacctgttactgcagctaaggagcttcacatcatgtggttttggttcatacacttttaacacttgttgatgaattcactatcaaatgtttttagaatagaatatgatatttcggtttgatgttatttttgggacaaattcagaaagataaaaaatatcaggtttgaaagcgtagaaattcagtgaagaattggaatttgccttcacatggctaacttcaggaagggtctggaaagtaatgtgtgtgaactttaatagatggctccctctaaggtgcgaaactgttagagggtcagatgtcatagagcttgcatattcagtgtgttaccctagaaaaaactttgtcaattggaagtgagttaattaaaagacactttgtttttccagacaccgcacaaaagaggaaagtagctgattaaaagccagggtggggagaggtaaaatgaacactgttcataacaaaaacaccctgtgaattaagatcagataccactttgcctgcagtgctagctggaaaactagcatcgacttagcaaaagtttttaagtgactgtcagatgtaacaggcattcttgaaccagattcgtgagaatcacaactgtacaccctttctgtatttttggggttttttttccacgaaagacttggtcattttaaacaaagtgacttaatttacagtgtctggtttgcctaatcattcagctctctcatgtagtattccttctttttttaatttaaaatttttttatttcaataggttgttgggaacaggtggtgtttggttacatgcgtaggttctttagtggtgatctgtgagattttggtgcacctgtcaccagagcagtgtacactgctcccgatgtgtagtcttttatccctcgccacccaccaccctttgccccaagtccgcagagtccagtgtgtcattcttacacatttgtgtcctcatagcttagctcccgcttaggagtgagatcatacgacgtttgattttccattcctgagttactgcacttagaataatggtctccagttccatccaggttgctacaaataccccttttttgttcctttttatggctgagtagtattccatggtatataaataccacattttctattgatgggcatttgggctggttccatatttttgcaactgcaaatcgtgctgctctagacatgtgcatgcaagtctctttttcgtataatgacttattttcccctggcagtggggttgctggatcaaatggtagagctacttttagttctctgagcaacctccacactgttttccttagtggttgtgctagtttacgctcccaccagcagtgcagaagtgttccctgttccccacatccctgccaacatctattcttttcattttttggttacggccattcttggaggagtaaggtattgcattgtggttttgatttgcattttcctgatcattagtgatgttcagcatttttttatgtctgttggccatttgtatatcttctttagagaattgtctatttatatccttagcccacttttggatggggttgtttgtttttttcttgctgacttttttgagttctttgtagattctggatattagtcctttgtcggatgtatagattgtggagattttctccagctctttggatttgtacactctttttggagagctgtctagcaatttgacctaaaagccttaaaatgtacatatgccttgacctggtagttcttctaggtctctctccaaaggaaagaatcaaacataagtttttaaaaaatttacccacaaaaggtttcacctcctcattgtaaatttttaagaaacagtggaaccagtcctgagcatctaacggtcagttcagctgcggcgtgactaccatggagtgttaggtagccactgcaaagtaacaagagcatcagcaacagagcaaaatatcggttggaaagctaaatgtggggaaaaaaggagcatgtaacatgaccgcggcaatgtaaaagaagcaccaatacatgggggaaaaatgggaaagaagcgttccgggtagccatgatgacttctggtttcttctccatattttccaaattttctataataagcagtcaatactttgtcattaggaggaagaataaacttttcttttaaaggcttgtgtttactttcagaagtcaactctgatctcactggcatgtttttctttatactctcttcccatttgcttcctcagttcatcctcttacctagaactttttgttttctttatctttctgtttttccactaaaagctccgtttttccatcttcccattactctccctttcctgtgtacactcctgaagacaggcatcctcataaggtgttctgaattaactttagggtgttctccaggtactttgcatctttttatatttcttgtaaattgttaatttctaagctccatgattaaagagaattcaccact

SEQ ID NO: 193117 - DNA, 2843 bp, Homo sapiens
  Payload ID: 18129
  Gene Name: transmembrane and coiled-coil domains 3
  Uniprot ID: Q6UWJ1
  ENST ID: ENST00000474393
  CDS Start-End: 259-1833
ctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtaattctcaaactatgtgttatttatgtaatctgatacataatctctttcactgaaatcttgtgatccattctttacctttccattttaataatggttaaaatatttgaaacatttactagtattttttattttatacacactttcttatactacccatcaaaatataatacagggagctaaacccgtttaactggtttgactcatactcttaagcactttgctaaaatagtgtttgtgagtatttcattaaaaacaaatccgtgggccgggtatagtggctcacacctgtagtcctagcatgtggggaagctgaggcaggagaatcacttgagctcagaagtttgggagcagccaggacaacagagtgagaacccctctgctacaaaaaatagaaaaaccagctggggcgtggtcgcgctcatgtatagaccagctgctggagagactgagctgggaggatggcttgagcccaggaggccaaggctgcagggagctgtggtcgcaccactgcactctagcctgggtgacagagcaagaccccatatcaaaaaaaaacggccgggtgtggtggctcacgcctgtcatcccagcactttgggaggctgaggcgggtggatcacaaggtcaggagatcgagaccatcctggctaacatgatgaaaccccgtctctactaaaagtacaaaaaaaattagctgggtgtggtggcgggcgcctgtagtcccagctactcaggaggctgaggcaggagaatggcgtgaacgcgggaggcggagcttgcagtgagccaagatcgtgccactgcactccagcctgggcgacagagcaagaccccatatcaaaacaaacaaaactgtgatgataaaaagcgccataaacactaatatcaaaccatgctactctgtcttaaattttcaaatagctttgcacctgaaatacaaaattaagtttggaaaaacagtttttaactgtgttgctcacaagctaattaactgtataagttctgccatgtgaaaggttaaaaaataaagttcattttggaaa

SEQ ID NO: 193118 - DNA, 575 bp, Homo sapiens
  Payload ID: 18129
  Gene Name: transmembrane and coiled-coil domains 3
  ENST ID: ENST00000619336
  CDS Start-End: 1-255
attctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggcctcacctcccaacgcttgcagtgcacatcgaggggacagaagcatttgaaccgtagcaggaaaccgacttgatgagagtaacatcaaactccccccaaaacacgaaattagcctctctctgcaagatgaaataagaagtgccctgaatgacgagagaaagcatgctagggtctctgcctaactgatcactcaggttacggtgaaatcctaccggatcaacatctgagaccaggcttatggaagtgagcttccaacctgaatgcttgaggctgagggggtgttggcggcctcgataacaacctgaacaacagctggcagcagggagtgcctgggccatgtgtccccagagcactgacctgggtggtccagtctcctg

SEQ ID NO: 193119 - DNA, 2974 bp, Homo sapiens
  Payload ID: 18130
  Gene Name: transmembrane and coiled-coil domains 4
  Uniprot ID: Q5TGY1
  ENST ID: ENST00000294543
  CDS Start-End: 243-2147
cgggcgggaggagccgctcgccggttttgccgcctccgcctttgccttcgcagccgcctccagtgttgtacattataaaccggggctgctgatgaggagtggggaactggctctctggaacgtgtgacagcaggcagaagggggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgaggacgtcatcctgctgggtgcgcctgtggagggagaagccaagcattgggagcctttccggaaggtggtgtccgggaggatcatcaacggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcaggcgagaccccccaccaggttgggcaaacccagggtcccatatccggagacacctccaaattggccatgtccacagaccccagccaagcccaggtgccagtagggctggaccagtctgaaggggcctcccttcctgctgctgccagccctgaaaggccccccatctgcagccatggcatggaccccaacccactgggctgccccgattgtgcctgcaagacccagggccccagcacggggctggactgaccacagcaggggacctgagccgtcttccccagtctccatatgcagctctctcttataccctcgggttcctcccaggagctctggaggtacaggatttccacaggcctctttcctaaatggaaggaattggaactgaaagggaaaggaaatggaaggaaggggaatttggaggagagaacacgcccacccttgggaagctgcctgtccccagaggagccccaccagggagcagctgccccctcatcagagacctgcagagtcaaccaagcacaggttagagtcccaggaccggaaaccaactgtgggctttctgtacttctcatagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacaccactaacagagcatggtgaatacatgctgaattgcattcagtatggctgtgaactaggcctggggacaagaatgaattttacatggaaagaatttcctgtagcaggaacagaggggataacaacagcaataaataataataagaagaagctaccacttcttgagcatgtaccaca

SEQ ID NO: 193120 - DNA, 2403 bp, Homo sapiens
  Payload ID: 18130
  Gene Name: transmembrane and coiled-coil domains 4
  ENST ID: ENST00000375127
  CDS Start-End: 272-2014
caaacagagaattccaggagggcttggggagcctctggagaaaaaccaggctcctcatgttacaaggaggccatgtcttctggtgcccatgcctgaagttacaggagggaagaattactgctgctgacttttgagtggattttacagctgggtaaactgaggctcagagagggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgaggacgtcatcctgctgggtgcgcctgtggagggagaagccaagcattgggagcctttccggaaggtggtgtccgggaggatcatcaacggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacaccactaacagagcatggtgaatacatgctgaattgcattcagtatggctgtgaactaggcctggggacaagaatgaattttacatggaaagaatttcctgtagcaggaacagaggggataacaacagcaataaataataataagaagaa

SEQ ID NO: 193121 - DNA, 1274 bp, Homo sapiens
  Payload ID: 18131
  Gene Name: transmembrane and coiled-coil domains 5A
  Uniprot ID: Q8N6Q1
  ENST ID: ENST00000319669
  CDS Start-End: 103-969
ggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaagattttttgctgtctctttttcatcaccctatttttcatcagactgctgagctacatgttttttcatgtaagattcataaatccagatctcctcgtcaatgtactgcccaaggtactgggcaggagcaccttgtggaagctcagatgcttcttctttccatctctcacacttgagacagaggacatgttaccccactgattccctaagaaatatccttgagcaatagaagggaagtgggatccgagcctgtagaagggaggcatgaaacttgtggaggaaagagatttgcttcagttttttcctcaccgtttgcctgcttgactaccttctgtcaccacgtcatctttccaggattaaccttgaccagtaaaaagctctgtaatagatttatgtggctctgtggatcggctgaatagtacttgatagtaaacaaatttgaccatttggggaattatatagatgctaagaaaagttaattgataaattattctagtgaatctcaa

SEQ ID NO: 193122 - DNA, 2894 bp, Homo sapiens
  Payload ID: 18131
  Gene Name: transmembrane and coiled-coil domains 5A
  ENST ID: ENST00000558158
  CDS Start-End: 155-727
agctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtgtgagctttggcaaaggaacatcctggttttggtagaaactccatctcagcctgagtcagagcaaacagttctcagaccaatttctatttggaattgaatgagtcccgacgccacatatctttgccctctgttagtgatctggttgaccccagtagatcacaccaacttaaaacttccagtcattctcccatccttctaaaaagaccacagaaacacatctcccttcgtaatgttatcacattatcacattattattcgggttgatattaagagtaaaaacatgtactttagaaagagttggtggtcagtcaccttgataagtagggtattccttatatatcacagaaaggccttttcattaataccatcctcacttcccccaaatatatggacacccaaccataagggataggcatgaaactaatctctagactcatactacagctaccacattatataaatcagaactgtacactgtattgaactacgaacatttaaaattagagatgggaaagcactcctcaaagtacaatgagtttgtcaagagtctaaatggtgagaaatccaaaccaaaaacctcatctccatttcttgaccccctctgtaagttaaatcttaatgcagtcaagaagtatttctatttatgaaatatttttaaatccttagatcaagaacaagagatcaaaactgcatatagcctctctctatatatatatagtccagggtcctaggacttgtaggtccttgcccctaaaggacaccttcaagtcactcaagatccctgctgaacattggtttatggcttaactgttaagccaagattctagaaaaggttgcccagtagaattttctgtgctagttagtaggtaaaactaactacatatggcaattgagtacataaaagatgtactcaactgaggaaattaatttaactttaattaatttaaatagctataggtagacagtagttacaatattggacagtacagatttagaatataaagcttttttaaaataaccatagtgtagtatgaatatttcagtgcactttgttcaatttctgtcctggctgttatcttcatagatcaaaactcgtgagcatgaaccctgtggaaaaagagcataccagccaaaataatgaggtaaacactccattctctcttcagctcctcacagtgtcattgcctttcaaagccatctccagcaaactataaggcaccaaatatatacccaatcttgccatgcgcattttccaagaacagtaccagctataattacagagcattccaaccctaaacaaacaaactagactctaaggaacaatctactttcttctcattcagccatacaaataacaggctctcaaaaaactagccgaagacctaagagaactcagaatggaggcaagaagcaaccttaattgagggtatgctctatagaaagaggccaatatagggcacatacaccacctcttccatctcctacaatcacagtactctttcctgatgatcttgacatggttcctaatctctcacaacacagagcacccaccatctgtcatcatctagtcagaattggcctgtgagttaaaacatagaacgctattgcttctttgtgacagagtttcagtgtctgttcatatttaatatagcaaagccaccagcacacatgtaaaggtctgaaggaaaagaacaatttcatacagagcaccaatcctcttggcctgcttgatgtcttgtggcagcaaggataaaaggttaaagttaaactttggttgggctttaattttgtaatttatattggctttagagtccaggttgacaaacatcagaaattacagatagtcaagataaatacttagaaaagagaactaaacacttccttaaaagcaaatatcaaatattggccattgtgtttgggtcatccaaatgtttggatatatgttaggccatgtccatggttcttaagagtactgaacaagtcattctggccccgaagcttgcatattctgcttagtaaacaaaatccctgaaattaactcgacccacttctgtagaaccaagtttttgacatctccaatgtgtcctaccatctctccccacagctcatcaaaatattccttctaactatgtgtcagaggaaaaaattaaagttgtctacatcaagctca

SEQ ID NO: 193123 - DNA, 579 bp, Homo sapiens
  Payload ID: 18131
  Gene Name: transmembrane and coiled-coil domains 5A
  ENST ID: ENST00000560841
  CDS Start-End: 368-579
atactctggagtctgcatgccagattcatgccctcccctgagttctggccaggtttcttgaccagttcaaactgttacaaaattcagctggaggttttgctctccctgtggcattttccctgcgcctctggccaccctccagaaggatccctgtagtgccaagcaggaatggcctgcttggggacctagcaagctcacagggcctttcccattgcttcctctatccctgtattgtgttcagctctctacattggctcagctccagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccac

SEQ ID NO: 193124 - DNA, 839 bp, Homo sapiens
  Payload ID: 18131
  Gene Name: transmembrane and coiled-coil domains 5A
  ENST ID: ENST00000558625
  CDS Start-End: 407-839
ggaagcatcacaggaaaagctttgggttttcatgccttcccttcatgctcctagatctgctggactctgtgtccatctcagcacaactggagggcttctcttgtccaccaagcttcttaccacatctacaccccacttaacgggtctgagaatgctcagtcgcttcttctgcgccaccctaattatacttgcaacaacctcctcactcttacctccttcacctgtttatgtttcctcatggcagtgttaccaagcaaaagagtgtcactgcccaatgtgctggaagccaatactatgacacaagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaagg

SEQ ID NO: 193125 - DNA, 575 bp, Homo sapiens
  Payload ID: 18131
  Gene Name: transmembrane and coiled-coil domains 5A
  ENST ID: ENST00000558148
  CDS Start-End: 333-575
agaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcagcgcaaggggttatttaaggaagcaaagcttctcaagaaaccagagtgaaggtgcactgttagattgagcactttggaggagaaagcctgggaaagacccttgctgactgagctgcgaattatcgaaacagttgtagagcatgatcaagaaatgtaatttttcaagaatgaaaatggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctg

SEQ ID NO: 193126 - DNA, 1072 bp, Homo sapiens
  Payload ID: 18131
  Gene Name: transmembrane and coiled-coil domains 5A
  ENST ID: ENST00000560653
  CDS Start-End: 142-714
gggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaaggtagagcttcttgaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaagattttttgctgtctctttttcatcaccctatttttcatcagactgctgagctacatgttttttcatgtaagattcataaatccagatctcctcgtcaatgtactgcccaaggtactgggcaggagcaccttgtggaagctcagatgcttcttctttccatctctcacacttgagacagaggacatgttaccccactgattccctaagaaatatccttgagcaatagaagggaagtgggatccgagcctg

SEQ ID NO: 193127 - DNA, 1939 bp, Homo sapiens
  Payload ID: 18131
  Gene Name: transmembrane and coiled-coil domains 5A
  Uniprot ID: Q8N6Q1
  ENST ID: ENST00000559502
  CDS Start-End: 172-858
agattagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaaatgggcctcctccttttagtggcaagatggctgccaacaatccagatctcgtactaccagattggcaacctttgcagaataaaagtcttttccaacaggttcagcagtaaagtccagaaaaggtcataaactggcctatctgaggtcaattgcctaccctgtcccacagtcaatgtggccagagggatggagtactctgattggtcaagcttatgtcatatgttcagccccttactaaggattaagagcagtcaaagaagaagaacaaagtaagggaatgacctaaactatatgaaatgcatttctcccactaaaaggggctcagtgcctatggaagagaaaagggatgctggacacgcaaaagcagaggtctacttcattgctaaactctgtgtcttcctataagcaaaaattataacttctaaagatagtagattaagacggtgaaagcttctacaaagagctcagtttaagaaccatgtaaataatcaggtcactagggctaaagtaagcaacaattctaaaataagtagaatatgactggtataaattgcttcaccaactcaaagtagcatatatatcacacctcttatttttccaattaattgctgaaacattcacatgccttactaataggatatactctacattattttccagtacaagagaaaattattttaaatggtaaggttttaggtctaaaagtgtctcaattttaagaaagctgatatcaagcaggtcatattttctaggcattgtgcaatgactatagaaattatgaaaatgtgtaaccaaccagtaatatctagccacaggcaaattttataaaagatccttttaattaacttctggattaaatggaaaatccaaactgagattacttttatagggtcagttacatgctaaggaggaagcatagagagtagaagaatggttaccagaggctgtaaccttcttaatttaaggtaaaaaattctacctattagcttagtattagatgaaaacagaaattcttgtcacatacaggcactattcactgcagtgaagtatatcttttcagaaagttgcataaaatcgaataaaataccatgtattaaatt

SEQ ID NO: 193128 - DNA, 1834 bp, Homo sapiens
  Payload ID: 18132
  Gene Name: transmembrane and coiled-coil domains 6
  Uniprot ID: Q96DC7
  ENST ID: ENST00000252100
  CDS Start-End: 25-1524
cggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccccctgcttctgccagcagctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagcta

SEQ ID NO: 193129 - DNA, 1887 bp, Homo sapiens
  Payload ID: 18132
  Gene Name: transmembrane and coiled-coil domains 6
  Uniprot ID: Q96DC7
  ENST ID: ENST00000394671
  CDS Start-End: 102-1583
gttcccgccctgtgctgaggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagagctgtgtctgtatacactgggtaacctgatcgtggagagtgaggctgtgagaaggcagctcctgccacagggcattgttccagccttggctgcctgcatccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagtttgcctggtgccttcattacatcatctgcagccaggtcagcaatcctctgctcattggccatggggctctgtctactctggggttgctgctgttggacttggctggggctgtccagaaaaccgaggatgcaggactggagctgctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactgcaaacagtcctagtttctgtacctccttgctctccctggatctgattgagcctctcttacagctgttgccagtatctaacgtggtgagcgtaatggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatatt

SEQ ID NO: 193130 - DNA, 542 bp, Homo sapiens
  Payload ID: 18132
  Gene Name: transmembrane and coiled-coil domains 6
  ENST ID: ENST00000513002
  CDS Start-End: 372-542
cctgtgctgaggctgcgcagtcggtgccatcttctacgcccctgggagcgttgtggctgctgtttccttcggctttcctcctcctgctccaccatgtggagccgacggcagggccgcctcaggcccacgcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcata

SEQ ID NO: 193131 - DNA, 611 bp, Homo sapiens
  Payload ID: 18132
  Gene Name: transmembrane and coiled-coil domains 6
  ENST ID: ENST00000515653
  CDS Start-End: 39-344
gctgctgtttccttcggctttcctcctcctgctccaccatgtggagccgacggcagggccgcctcaggcccacggtctgcggggtggaggagctacggcgccgccggcgggagcgggaggcagcactgcggaaggcgcggagggagcagcagctggtcagcaagaggctgctgagaaacgacgccccagaggaagctggagagggatgtgtggctgcgatcctcggggaaaccgaggtgagggggcaaggtgcagcagttcctgcggcaagcccagcgggggacagaggaaaaggagagagagggggctctggtcagccttcgtcgaggcttgcagcaccctgaaacacagcaaaccttcatccggtagctccagcctctgccctgtgccaaggggctgaaagtctctgaagacctgatgacccagcttccagtcagatccttaccctgtctacttccagtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctca

SEQ ID NO: 193132 - DNA, 540 bp, Homo sapiens
  Payload ID: 18132
  Gene Name: transmembrane and coiled-coil domains 6
  ENST ID: ENST00000509217
  CDS Start-End: 81-212
tgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggagcactgcggaaggcgcggagggagcagcagctggtcagcaagaggctgctgagaaacgacgccccagaggaagctggagagggatgtgtggctgcgatcctcggggaaaccgaggacactgtgctggtcactgaggtacacaaagatgaaaggatagagtccttttctttgaggtgctcacagcccggtgaagaagacagatgtcacaagggaaggaaacatgaggaacaagagaaactcctaagtctctcaaaaagagctaacttcccagaggaaatgaggagcagaaacctgaagagagtgggaagctggagagggtgcagcagttcctgcggcaagcccagcgggggacagaggaaaaggagagagagggggctctg

SEQ ID NO: 193133 - DNA, 811 bp, Homo sapiens
  Payload ID: 18132
  Gene Name: transmembrane and coiled-coil domains 6
  ENST ID: ENST00000505086
  CDS Start-End: 34-165
tgtttccttcggctttcctcctcctgctccaccatgtggagccgacggcagggccgcctcaggcccacggtctgcggggtggaggagctacggcgccgccggcgggagcgggagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagtaagccctgtcccttcctatcttgttcttggtttagattttaaaattgtgcttttgggaccagtttgagctggcaggtaggaggaagaaaacatgtttgcccttatgcctacagccatggctacacccatcatctccccaccctcttgtgagccgcaaggatagctgctccagcgtccccatcacctcccctccccatctccccacacgcagcctggcatgaaacaggccaagcccagtgcttttgttgcctgttctcaggagctgtgtctgtatacactggg

SEQ ID NO: 193134 - DNA, 543 bp, Homo sapiens
  Payload ID: 18132
  Gene Name: transmembrane and coiled-coil domains 6
  ENST ID: ENST00000504069
  CDS Start-End: 60-191
tacgcccctgggagcgttgtggctgctgtttccttcggctttcctcctcctgctccaccatgtggagccgacggcagggccgcctcaggcccacggtctgcggggtggaggagctacggcgccgccggcgggagcgggagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccgtccccccatgtggctgtgctggaagctctcggatatgccttgtcccagcttctacaggctgaggaagctccagagaagatcattccctccatcttggcctccactctccctcagcacatgctacaaatgttgcaacctggcccaaagctcaaccctggggtcgctgtggagttt

SEQ ID NO: 193135 - DNA, 375 bp, Homo sapiens
  Payload ID: 18132
  Gene Name: transmembrane and coiled-coil domains 6
  ENST ID: ENST00000394669
  CDS Start-End: 66-197
atcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggagcactgcggaaggcgcggagggagcagcagctggtcagcaagaggctgctgagaaacgacgccccagaggaagctggagagggatgtgtggctgcgatcctcggggaaaccgaggtgcagcagttcctgcggcaagcccagcgggggacagaggaaaaggagagagagggggctctggtcagccttcgtcgaggcttgcagcaccctgaaacacagcaaaccttcatccg

SEQ ID NO: 193136 - DNA, 1201 bp, Homo sapiens
  Payload ID: 18133
  Gene Name: transmembrane and immunoglobulin domain containing 1
  Uniprot ID: Q6UXZ0
  ENST ID: ENST00000328886
  CDS Start-End: 74-862
ggcagaggaacagttggccaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgtttcggtggtgctgaatgttacttttcctcctctcctaagtggaaacgacttccaaacagttgaggaaggcagtaatgtgaagttggtttgcaatgtgaaagccaacccccaggctcaaatgatgtggtacaaaaacagtagtctcctcgatttagagaaaagccgtcaccaaatccaacagacaagtgagtcttttcagctgtcaatcaccaaagtcgagaagcctgacaacggaacctacagttgtattgcaaagtcatctctgaaaacggagagcttggactttcacctgattgttaaagataaaactgtgggtgtaccaatagagcccattattgctgcatgtgttgtgatctttctgacattgtgctttggactgattgctagaagaaagaaaataatgaagctctgcatgaaggataaagaccctcacagtgaaacagctctatgagaaagctgagatgccatcgaatacagagagagttttgcatcaggacctccacaatttatgtagtcccatctgtatttattgctattattaaattcactcctgtcactcctgtttcattaatcacttaacagtagttgttaggactaatttgatacacttgtggaacatttttatggaaagagctattaagaatgaaaagtaagattttgttaagtcttctccttgaagtatatgttaattaattgagatttgttccaaataggttggtaatcatttactgtttagtgtgttttttttctaggtaggagatacttgggtctcacaaattggtgcaaagcc

SEQ ID NO: 193137 - DNA, 1124 bp, Homo sapiens
  Payload ID: 18133
  Gene Name: transmembrane and immunoglobulin domain containing 1
  Uniprot ID: Q6UXZ0
  ENST ID: ENST00000538566
  CDS Start-End: 86-742
ttagggttttcaggcagaggaacagttggccaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgtttcggtggtgctgaatgttacttttcctcctctcctaagtggaaacgacttccaaacagttgaggaaggcagtaatgtgaagttggtttgcaatgtgaaagccaacccccaggctcaaatgatgtggtacaaaaacagtagtctcctcgatttagagaaaagccgtcaccaaatccaacagacaagtgagtcttttcagctgtcaatcaccaaagtcgagaagcctgacaacggaacctacagttgtattgcaaagtcatctctgaaaacggagagcttggactttcacctgattgttaaagctctgcatgaaggataaagaccctcacagtgaaacagctctatgagaaagctgagatgccatcgaatacagagagagttttgcatcaggacctccacaatttatgtagtcccatctgtatttattgctattattaaattcactcctgtcactcctgtttcattaatcacttaacagtagttgttaggactaatttgatacacttgtggaacatttttatggaaagagctattaagaatgaaaagtaagattttgttaagtcttctccttgaagtatatgttaattaattgagatttgttccaaataggttggtaatcatttactgtttagtgtgttttttttctaggtaggagatacttgggtctcacaaattggtgcaaagccaaaaaaaaaaaaaaa

SEQ ID NO: 193138 - DNA, 1262 bp, Homo sapiens
  Payload ID: 18134
  Gene Name: transmembrane and immunoglobulin domain containing 2
  Uniprot ID: Q96BF3
  ENST ID: ENST00000301272
  CDS Start-End: 47-895
ggaagtctgtcaactgggagggggagaggggggtgatgggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtgaagaaaaa

SEQ ID NO: 193139 - DNA, 489 bp, Homo sapiens
  Payload ID: 18134
  Gene Name: transmembrane and immunoglobulin domain containing 2
  ENST ID: ENST00000600114
  CDS Start-End: 1-489
atggggtccccgggcatggtgctgggcctcctggtgcagatctgggatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtga

SEQ ID NO: 193140 - DNA, 1212 bp, Homo sapiens
  Payload ID: 18134
  Gene Name: transmembrane and immunoglobulin domain containing 2
  Uniprot ID: Q96BF3
  ENST ID: ENST00000595645
  CDS Start-End: 9-845
ggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtgaagaaaaa

SEQ ID NO: 193141 - DNA, 333 bp, Homo sapiens
  Payload ID: 18134
  Gene Name: transmembrane and immunoglobulin domain containing 2
  ENST ID: ENST00000600349
  CDS Start-End: 1-333
atggggtccccgggcatggtgctgggcctcctggtgcagatctggggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtga

SEQ ID NO: 193142 - DNA, 1517 bp, Homo sapiens
  Payload ID: 18135
  Gene Name: transmembrane and immunoglobulin domain containing 3
  ENST ID: ENST00000369716
  CDS Start-End: 135-1178
gcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaa

SEQ ID NO: 193143 - DNA, 1150 bp, Homo sapiens
  Payload ID: 18135
  Gene Name: transmembrane and immunoglobulin domain containing 3
  Uniprot ID: P0DMS9
  ENST ID: ENST00000369717
  CDS Start-End: 11-811
agttggaccaatggaagggtctccagcaggacccattgagcagaaggaggccaggtgggaaagctcctgggaagagcagccagactggacactgggctgcttgagtcctgagtcacaattcagaattcctgggctccctgggtgcattctatcattccagttgaaagtttgcttccttccagtcatgtggctcttcattctactctccttggctctcatttcagatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatgaa

SEQ ID NO: 193144 - DNA, 637 bp, Homo sapiens
  Payload ID: 18135
  Gene Name: transmembrane and immunoglobulin domain containing 3
  ENST ID: ENST00000443498
  CDS Start-End: 1-519
ggacccattgagcagaaggaggccaggtgggaaagctcctgggaagagcagccagactggacactgggctgcttgagtcctgagtcacacaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctcta

SEQ ID NO: 193145 - DNA, 957 bp, Homo sapiens
  Payload ID: 18135
  Gene Name: transmembrane and immunoglobulin domain containing 3
  ENST ID: ENST00000414219
  CDS Start-End: 1-477
aagcctcaggctcttcaaggccctccgtcaagcaatgatgccatggtcatggatgaaaaggtcaagagaagctttgtgctggacacggcttctgccatctgcaactacaatgcccactacaagaatcaccccaaatactggtgccgaggctatttccgtgactactgcaacatcatcgccttctcccctaacagcaccaatcatgtggccctgagggacacagggaaccagctcattgtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaagaccgctccaggacgtccattctcatcatttgcatactgatcacgggtttgggaatcatctctgtaatcagtcatttgaccaaaaggaggagaagtcaaaggaatagaagggtaggcaacactttgaagcccttctcgcgtgtcctgactccaaaggaaatggctcctactgaacagatgtgactgaagatttttttaatttagttcataaagtgatgctacaacagaataatcaccatgacaactggcccacacctcagagactgattctgatctcccaggaattctgaaggaccctctatccttgacaacaatcatttgcagccaggtagcaacggcggtagtcagaggagctatgatagaccacacccaagcaaggctgccctcaaataacatctcaagatcttagttcttatgcattccatcagtcagaagtgaagaagaggtggagaatctggattggggaccaggaaatcacttgtattttgttagccaataaattcctagccagtgttgaatg

SEQ ID NO: 193146 - DNA, 741 bp, Homo sapiens
  Payload ID: 18135
  Gene Name: transmembrane and immunoglobulin domain containing 3
  ENST ID: ENST00000472933
  CDS Start-End: 1-324
gtcactatgtcctgcctgaccaaagaggacacgggctggtactggtgtggcatccagcgggactttgccagggatgacatggattttacagagctgattgtaactgacgacaaaggaaccctggccaatgacttttggtctgggaaagacctatcaggcaacaaaaccagaagctgcaaggctcccaaagttgtccgcaaggctgaccgctccaggacgtccattctcatcatttgcatactgatcacgggtttgggaatcatctctgtaatcagtcatttgaccaaaaggaggagaagtcaaaggaatagaaggggtaagtagctattgttgagggagggggtgggcaagaattagagaaaatgaaagaggtcaaggagcagatttcaaatgagtgaatgagagcctcttcatattgcctggtcacctggagaccaatgcagccagccatgggctggggtagatatctgcttgatggtgacaaggcatcacgagaagtgacagagggagcactggagctttcttaagtggatacatgtgtaggtcaggaaggaaggaggtcctgagacaaccacaccaggttcccatctgcagagccacctacctccccagcacacaaacttcgggctcctgtcgaaggaatgagcttctgggaccgctgggtaagcaggtatagaagagtctcctttttcatatacacaggatgttgccctgttgcccaggcttgagtgccgaagtatg

SEQ ID NO: 193147 - DNA, 8805 bp, Homo sapiens
  Payload ID: 18136
  Gene Name: transmembrane and tetratricopeptide repeat containing 1
  Uniprot ID: Q8IUR5
  ENST ID: ENST00000256062
  CDS Start-End: 475-2799
agatagaaaaagtagtttgcttggcatctcccaaattatcttgagcaaacaataaaataagaaatgtttcagaagacaattcggctcccaggcccaaaccaaaactcgaacctggtactttttgtaagtgcgggccaagaaaggggctgtaaagttaaagagccggtggcgcctctgaacacacccgggcagggcgagcaggatgtccttgtccagggagaccccttctcctggctttgaggaaggtgctccctatccccgcgggttcctccgccaagcgggacgccgcgccgggcgggtgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatatgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataa

SEQ ID NO: 193148 - DNA, 2758 bp, Homo sapiens
  Payload ID: 18136
  Gene Name: transmembrane and tetratricopeptide repeat containing 1
  Uniprot ID: Q8IUR5
  ENST ID: ENST00000539277
  CDS Start-End: 60-2708
gtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggg

SEQ ID NO: 193149 - DNA, 4228 bp, Homo sapiens
  Payload ID: 18136
  Gene Name: transmembrane and tetratricopeptide repeat containing 1
  ENST ID: ENST00000551659
  CDS Start-End: 147-2981
gcgcggggagctcgcggcgggtccagctgccgcagcaccatgcccgagcccccctccgggcagacgccgcgcgccgccggggccccggtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatata

SEQ ID NO: 193150 - DNA, 3915 bp, Homo sapiens
  Payload ID: 18136
  Gene Name: transmembrane and tetratricopeptide repeat containing 1
  ENST ID: ENST00000552618
  CDS Start-End: 48-2768
gccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatata

SEQ ID NO: 193151 - DNA, 593 bp, Homo sapiens
  Payload ID: 18136
  Gene Name: transmembrane and tetratricopeptide repeat containing 1
  ENST ID: ENST00000550354
  CDS Start-End: 1-393
ttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaataataataaagcttgggattatctatgctggagattcagaaaaacactgacagatctgccatagacctccagagctctccgactgttcggttaccctggagaaggtttctaacattctaccttgtgtgatgggagtagaaagtccagagaccacccaacaagtcagcccttcctacacaaaaactcccaagaaatgcctcagctaataagccccgaaagagaaatagtgattctccctgaataaagtcaagatattgatgtgta

SEQ ID NO: 193152 - DNA, 5681 bp, Homo sapiens
  Payload ID: 18137
  Gene Name: transmembrane and tetratricopeptide repeat containing 2
  Uniprot ID: Q8N394
  ENST ID: ENST00000321196
  CDS Start-End: 708-3218
gtcacgcaggcgcggggggccgcgtcgagaaccccacgcgggagcttctggagtctccagccaccgcttctcacttcactggagaagggagctggggctggggctggggctggggctgggagggagctaataaacattgaatgtgcagcagctgccttggcggccggagtccgcccgagcgacaccggagcagtgcgcccgggaggcggcgaggggaggcggttcgccttgtccctcccacccgcgcctctttctctctcttcctccagctggtcccagagcccggcttggtccggtccctctgcccccatcccgcacccttccacctcctccgagtcccactcctcacctaggacgccccaaactgccatgggttagggtggggatcgcgacccgcgcgaaagaccagccctgcgcttccgccgggggacgcggagcccaaacgccgctcaccgcttgcgggcgccgggcatggggagtgtggtgtgagcccgcacccggggaggacgcaggagctgcggagacgggcgcgaggaggaggagaggagtcgtggattggaaggacccgagggagggagggtggggaagcgagggaaaagtgaagctgggaggagaaggcggcggaaggtggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaaaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctatgtccagataccctcagttttgattggtcaatggatgctgtgcctctgctcaaaacagtttgtgactggagaaacctacacactgtggccttctatactggactccttctccttgcctactatggtttgaagagcccgagcgtagacagagaatgcaatgggaaaactgtaacaaatggcaagcagaatgcaaatggacatagctgcctttcagatgtggagtaccagaactcagagactaagtccagctttgcatccaaagtagaaaatggcattaaaaacgatgtatcacagagaacccagcttccttctacggagaacattgttgttctgtctttatctttgttaatcataccctttgttcctgccacgaacctgtttttctatgtcggctttgtaattgcagagcgagtattatatattcctagtatgggcttctgcctactgattacagtgggtgctagagccctttatgtcaaagtccaaaagcggttcctcaagagcttgattttttatgctacagctacactaattgttttttatggactcaagactgcgatcaggaatggagactggcagaatgaggaaatgctttatagatcagggataaaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctaccctggcttctgcatatttaaataccggtattattctaatgaaccaaggaaggacggaagaagcccgacggacattcttaaagtgttcggagatcccagatgaaaacctaaaggaccctcatgcacacaagagctctgttaccagttgtttgtacaacctaggaaagctgtatcatgagcagggacactatgaggaagcccttagtgtatacaaggaagcaattcagaaaatgccaaggcagtttgccccacagagcttgtacaacatgatgggtgaagcatatatgcgtttaagcaaactccccgaagcagagcattggtatatggaatcactgagatccaagactgaccacatccctgctcatctcacctatgggaagctgctagctctaacaggtcgtaagagtgaggctgaaaagctcttcttgaaggctattgagctggatcccaccaaaggaaactgttacatgcattatggtcagtttcttctggaagaagctcgtctcatagaagcagctgagatggcaaaaaaagcagctgaactagacagcacagagtttgatgttgtcttcaatgctgcccacatgctcagacaggctagcctcaatgaagcagctgagaagtattatgatctggcagccaggctgaggcctaattatccggctgctttgatgaacctgggagccattctgcacctcaatggcagactccagaaggccgaggccaactacctgcgggccctgcagctcaagccagacgatgtcatcacacagtccaatctccgcaaactgtggaacatcatggaaaaacaaggcttaaagacttctaagacctgacacaggaggcagaagcccatcctcctccatttttaaaagctggcttccttagcagacagaacttcccagcagtgctatgacaagagctggtgttagacttcaagaccagggcagaggtcattgaggtcactaccgcttctggaagaatccactttgctgtaggcacagctgttaacaccaaaaaggggaaagccggaaacctcctggaggatgtcattgttacccatagactgtaaaccagagcacttaaaacagaaccttttggcattcttaaaaagggaggggtgggtgtgtaagtcacagattttgttcattttctgaaagctaatttcaaaattatgttgttccttaaacactgtgagaggaagtcagagtgtccattcaggcatggcaaacaattagggttaagtgttacgagggagtgataaacacgtagtgtgagtcccagtgagccgccggttgtcctaacgctgctgtcttccctgtttgggacagcctgcttatcaatttctgaagcttagaacactttttttaatactgtgtcaagatctgtcagaatctgctatgtttcttgaccagtgcacataatgttttatgatttggatgtcagaggcttcattcttttggacatcatttgctttttatgttctgaaaaggatatggagagtagagctaaccatacttcacactcgagttgtatgagggactggggaggccttatatgtgtcaggcaggcattttttaaattttaatatcgtcaatattttcccccaaactgcccagtagaattcattgtattaattcttttgaaattacctttgaaaatagctattcctggagaatgtgcaagcttacataaggataaaggacaggggaggagtttgtaagccttgcagttccaataactaaccaacaggttattagacaaaagggaaggtgttttgtgcttctcagatgttgctggtttaggagtgtgtgatgatgcttgccagtgattttgtgttttggaaagggtaggtatcgaatgttaatcactttctaatgggtacctaaacagcaatgctgataaatgttcaaggaattattttcatcttagtttgttcttctcaaaaggcatcaaaaacaacttatttgaagctgcaatagagtgtagcattagcctgcatgtttctaggtcttctgccaagtgcttttctcagttgaaaactatttttcactagcaaaattggtattttatttcattacctgttagtaactacttcaatgatcatttcacaagaaaaagactataaattaagtagagaacaacatttttattgaacatttttggcttgcaatcaaactttgccactaaaaattaacttcataaaacactagtccgttatcaacttcttcacagagaaagtagctatactataccctacatatttatttatttattattctactatagcagaataacaaaacttgatgcattaagccagttctttgcaactgaaaattacctgtttctccttccctttcacactccatgtatatatgatcagcctctccattaaaaagaagctggacatgcaaatacatcatattatgttttctccatattttatgtttttctatgtatctgaatacagtgggataaataattgaaagtagtgttcctatggcattagtgtttttgtgagaagggtaaatgtagtgagaaaggttttttcatggcattaataagaaagcccttctgtaatatatatattattttgtaaacatttcactgaagggccaaaagttaaattataactaaatcactgtgttttcagaatgatatttaacaacaaacccgtggtcaaaccaaaatagtgggttgaagtgtattattcatcttttagtgcattggcaattgcaaaaaaaaaaaaggaatttaatataaggctatagagattaattcagtgtctaacatttgtatttatttaaatagttattgacctatgatgactttctagtcttaacattttatctttttattgttgttgttcttcctttcaaagatgtggttcttaataggttcactgaatgcacagttgaggcacttcttgtgacaccagttcccaagtagcgttaataattgggcctgtgtcataaaatgcacggatcattaataactaaatgtccctgacacttttcactacagggctggacttagtaactgaccaacttcggggggagggttggggcaagggggggtgggcgttagaacatgatcaaaaaatgtctccgctcagggatttatggtggattattgcagacagtgctaaaaatatagagcacaagacaagtttactaaattaaaattttattttttgagaaactgttatttgtataaattatcaagatttgtaggctttccttttgtagaaataattgttttatgtgccagagaatttcaattttgttttcaacaataaa

SEQ ID NO: 193153 - DNA, 6211 bp, Homo sapiens
  Payload ID: 18137
  Gene Name: transmembrane and tetratricopeptide repeat containing 2
  ENST ID: ENST00000549919
  CDS Start-End: 1806-4298
tctagagttatcaatctgaattataaattttgtaaaattattcacaaaagcacttattttgtaagtgtagtgtagaatgttagatgtatgacctataattaattccattaatcctcaaataaaactgtggaatcattttcctttcaaacagcagtttaaattcaaactgtattaccattagcataagaatagcttttaacaataattaaaatcctaatggtatcatgaaataattttagtttagttatccttttgatgtaaatatttatccagtgggagaacctgatttgttaaacattttatatgaatttgatttgagaaatgcacagcaccatataaatatatcactgtaggaggcagtgtagccataaggaaaacataccggattgagtgtcaagaactggtgtctgtatggtgctgtactgcacaagcttcatatgaccttaatttccgagcatcagtttcatcattggttaaaaaaaaagagatgacagtatcagacttgcctcacggctgtctgccaattaagtgaattagaaaattattttcaattatatagtgctgggcaaggtgaatgattgctattactgttgtcatcactgttgtttgaagcactgtgctttgggaagcaaatctggttcacatcttttgaacatttaaatgaagagaatgtgtctcagtgctctagtgtgtattaaaacagccttttaacaagaatgttttgaaccctgcccaatacctgcacatgcttttgttaatacttcattacataaaatgaccaagaagctgtcataagaatttaaaggaacatttaccctcatctttaaaatgtatcttaaaagagagataagattctaattacaaattttgaacagtttattttctctctatgaaaaatttccaagaatgatacaaaagcacttttatgtgaagaggatacactggaacattgaggtcttgatctcattttagtaactctctgatgtgattaattcataagcactgagttgtagctcattccttctggcaaaattccagcacttgattgttaccttataaacttttaataagagtaattttaaaaactgcacttgactcttgctttatgaaaagctggaaatgtaaaaagttaaaaatgcttgacaatttttctgagctctagtcagaaacagtggctatgcccttttatagatgacagcccaaaggcgagtttgtaaaacgataaataaattgtaaagatctatcgagtggcaacttggatggtttaatgcctatgggttagaaacccaggagttaatgtttaaagtgatttggataaatgtgaacatgtttaaatctttagtattattcctttaagccaaatgtgaacgatagttattttgacaaagtttgggttacctcgatagcctgatttttacagaagtaccgtgtatctcaaattgttaactgatgaatgggtggtgctgctggattatttcctgtgttttgtgtttttcttagttttaatttctttgttattcaagttatactatcacctcgtccaaagttgggtctcaggattagattaataaactaaccaagtaaatttgggaagtatgactaacttacataaagaaaataattggggttatttttttgtattattattttaaaatatgtaatcagcacttttgagaagctctcattttgttgaatctctaggcagacctttgtggttaagcatcatcctggaaattttttctgacagtcatttgaccaggtctttctgtttatactcagtgtcaaaacaacaacaacaaaaatgcatggaaccatctagttgcaggaaaacaagctcaggactcaggactcccactgattatacattatgccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaaaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctatgtccagataccctcagttttgattggtcaatggatgctgtgcctctgctcaaaacagtttgtgactggagaaacctacacactgtggccttctatactggactccttctccttgcctactatggtttgaagagcccgagcgtagacagagaatgcaatgggaaaactgtaacaaatggcaagcagaatgcaaatggacatagctgcctttcagatgtggagtaccagaactcagagactaagtccagctttgcatccaaagtagaaaatggcattaaaaacgatgtatcacagagaacccagcttccttctacggagaacattgttgttctgtctttatctttgttaatcataccctttgttcctgccacgaacctgtttttctatgtcggctttgtaattgcagagcgagtattatatattcctagtatgggcttctgcctactgattacagtgggtgctagagccctttatgtcaaagtccaaaagcggttcctcaagagcttgattttttatgctacagctacactaattgttttttatggactcaagactgcgatcaggaatggagactggcagaatgaggaaatgctttatagatcagggataaaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctaccctggcttctgcatatttaaataccggtattattctaatgaaccaaggaaggacggaagaagcccgacggacattcttaaagtgttcggagatcccagatgaaaacctaaaggaccctcatgcacacaagagctctgttaccagttgtttgtacaacctaggaaagctgtatcatgagcagggacactatgaggaagcccttagtgtatacaaggaagcaattcagaaaatgccaaggcagtttgccccacagagcttgtacaacatgatgggtgaagcatatatgcgtttaagcaaactccccgaagcagagcattggtatatggaatcactgagatccaagactgaccacatccctgctcatctcacctatgggaagctgctagctctaacaggtcgtaagagtgaggctgaaaagctcttcttgaaggctattgagctggatcccaccaaaggaaactgttacatgcattatggtcagtttcttctggaagaagctcgtctcatagaagcagctgagatggcaaaaaaagcagctgaactagacagcacagagtttgatgttgtcttcaatgctgcccacatgctcagacaggctagcctcaatgaagcagctgagaagtattatgatctggcagccaggctgaggcctaattatccggctgctttgatgaacctgggagccattctgcacctcaatggcagactccagaaggccgaggccaactacctgcgggccctgcagctcaagccagacgatgtcatcacacagtccaatctccgcaaactgtggaacatcatggaaaaacaaggcttaaagacttctaagacctgacacaggaggcagaagcccatcctcctccatttttaaaagctggcttccttagcagacagaacttcccagcagtgctatgacaagagctggtgttagacttcaagaccagggcagaggtcattgaggtcactaccgcttctggaagaatccactttgctgtaggcacagctgttaacaccaaaaaggggaaagccggaaacctcctggaggatgtcattgttacccatagactgtaaaccagagcacttaaaacagaaccttttggcattcttaaaaagggaggggtgggtgtgtaagtcacagattttgttcattttctgaaagctaatttcaaaattatgttgttccttaaacactgtgagaggaagtcagagtgtccattcaggcatggcaaacaattagggttaagtgttacgagggagtgataaacacgtagtgtgagtcccagtgagccgccggttgtcctaacgctgctgtcttccctgtttgggacagcctgcttatcaatttctgaagcttagaacactttttttaatactgtgtcaagatctgtcagaatctgctatgtttcttgaccagtgcacataatgttttatgatttggatgtcagaggcttcattcttttggacatcatttgctttttatgttctgaaaaggatatggagagtagagctaaccatacttcacactcgagttgtatgagggactggggaggccttatatgtgtcaggcaggcattttttaaattttaatatcgtcaatattttcccccaaactgcccagtagaattcattgtattaattcttttgaaattacctttgaaaatagctattcctggagaatgtgcaagcttacataaggataaaggacaggggaggagtttgtaagccttgcagttccaataactaaccaacaggttattagacaaaagggaaggtgttttgtgcttctcagatgttgctggtttaggagtgtgtgatgatgcttgccagtgattttgtgttttggaaagggtaggtatcgaatgttaatcactttctaatgggtacctaaacagcaatgctgataaatgttcaaggaattattttcatcttagtttgttcttctcaaaaggcatcaaaaacaacttatttgaagctgcaatagagtgtagcattagcctgcatgtttctaggtcttctgccaagtgcttttctcagttgaaaactatttttcactagcaaaattggtattttatttcattacctgttagtaactacttcaatgatcatttcacaagaaaaagactataaattaagtagagaacaacatttttattgaacatttttggcttgcaatcaaactttgccactaaaaattaacttcataaaacactagtccgttatcaacttcttcacagagaaagtagctatactataccctacatatttatttatttattattctactatagcagaataacaaaacttgatgcattaagccagttctttgcaactgaaaattacctgtttctccttccctttcacactccatgtatatatgatcagcctctccattaaaaagaagctggacatgcaaatacatcatattatgttttctccatattttatgtttttctatgtatctgaatacagtgggataaataattgaaagtagtgttcctatggcattagtgtttttgtgagaagggtaaatgtagtgagaaaggttttttcatggcattaataagaaagcccttctgtaatatatatattattttgtaaacatttcactgaagggccaaaagttaaattataactaaatcactgtgttttcagaatgatatttaacaacaaacccgtggtcaaaccaaaatagtgggttgaagtgtattattcatcttttagtgcattggcaattgcaaaaaaaaaaaa

SEQ ID NO: 193154 - DNA, 2682 bp, Homo sapiens
  Payload ID: 18137
  Gene Name: transmembrane and tetratricopeptide repeat containing 2
  ENST ID: ENST00000548305
  CDS Start-End: 587-2500
gggagctaataaacattgaatgtgcagcagctgccttggcggccggagtccgcccgagcgacaccggagcagtgcgcccgggaggcggcgaggggaggcggttcgccttgtccctcccacccgcgcctctttctctctcttcctccagctggtcccagagcccggcttggtccggtccctctgcccccatcccgcacccttccacctcctccgagtcccactcctcacctaggacgccccaaactgccatgggttagggtggggatcgcgacccgcgcgaaagaccagccctgcgcttccgccgggggacgcggagcccaaacgccgctcaccgcttgcgggcgccgggcatggggagtgtggtgtgagcccgcacccggggaggacgcaggagctgcggagacgggcgcgaggaggaggagaggagtcgtggattggaaggacccgagggagggagggtggggaagcgagggaaaagtgaagctgggaggagaaggcggcggaaggtggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaaaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctatgtccagataccctcagttttgattggtcaatggatgctgtgcctctgctcaaaacagtttgtgactggagaaacctacacactgtggccttctatactggactccttctccttgcctactatggtttgaagagcccgagcgtagacagagaatgcaatgggaaaactgtaacaaatggcaagcagaatgcaaatggacatagctgcctttcagatgtggagtaccagaactcagagactaagtccagctttgcatccaaagtagaaaatggcattaaaaacgatgtatcacagagaacccagcttccttctacggagaacattgttgttctgtctttatctttgttaatcataccctttgttcctgccacgaacctgtttttctatgtcggctttgtaattgcagagcgagtattatatattcctagtatgggcttctgcctactgattacagtgggtgctagagccctttatgtcaaagtccaaaagcggttcctcaagagcttgattttttatgctacagctacactaattgttttttatggactcaagactgcgatcaggaatggagactggcagaatgaggaaatgctttatagatcagggataaaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctaccctggcttctgcatatttaaataccggtattattctaatgaaccaaggaaggacggaagaagcccgacggacattcttaaagtgttcggagatcccagatgaaaacctaaaggaccctcatgcacacaagagctctgttaccagttgtttgtacaacctaggaaagctgtatcatgagcagggacactatgaggtctggccaatgcctctctgtccttttccctcccccttgttctgatccagtctcagtggtttgtaacctacagcctcctttgagcctatgtcctttgaacaactaatatgtatacacgttaaactattgtcctttgagaaactaatacatgatgacattggaatggttttttgatcaaatttgtttagaaaaagcttctgctaaataaaaatttaatagatttcttt

SEQ ID NO: 193155 - DNA, 4527 bp, Homo sapiens
  Payload ID: 18137
  Gene Name: transmembrane and tetratricopeptide repeat containing 2
  ENST ID: ENST00000546590
  CDS Start-End: 107-214
aagctgggaggagaaggcggcggaaggtggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctatgtccagataccctcagttttgattggtcaatggatgctgtgcctctgctcaaaacagtttgtgactggagaaacctacacactgtggccttctatactggactccttctccttgcctactatggtttgaagagcccgagcgtagacagagaatgcaatgggaaaactgtaacaaatggcaagcagaatgcaaatggacatagctgcctttcagatgtggagtaccagaactcagagactaagtccagctttgcatccaaagtagaaaatggcattaaaaacgatgtatcacagagaacccagcttccttctacggagaacattgttgttctgtctttatctttgttaatcataccctttgttcctgccacgaacctgtttttctatgtcggctttgtaattgcagagcgagtattatatattcctagtatgggcttctgcctactgattacagtgggtgctagagccctttatgtcaaagtccaaaagcggttcctcaagagcttgattttttatgctacagctacactaattgttttttatggactcaagactgcgatcaggaatggagactggcagaatgaggaaatgctttatagatcagggataaaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctaccctggcttctgcatatttaaataccggtattattctaatgaaccaaggaaggacggaagaagcccgacggacattcttaaagtgttcggagatcccagatgaaaacctaaaggaccctcatgcacacaagagctctgttaccagttgtttgtacaacctaggaaagctgtatcatgagcagggacactatgaggaagcccttagtgtatacaaggaagcaattcagaaaatgccaaggcagtttgccccacagagcttgtacaacatgatgggtgaagcatatatgcgtttaagcaaactccccgaagcagagcattggtatatggaatcactgagatccaagactgaccacatccctgctcatctcacctatgggaagctgctagctctaacaggtcgtaagagtgaggctgaaaagctcttcttgaaggctattgagctggatcccaccaaaggaaactgttacatgcattatggtcagtttcttctggaagaagctcgtctcatagaagcagctgagatggcaaaaaaagcagctgaactagacagcacagagtttgatgttgtcttcaatgctgcccacatgctcagacaggctagcctcaatgaagcagctgagaagtattatgatctggcagccaggctgaggcctaattatccggctgctttgatgaacctgggagccattctgcacctcaatggcagactccagaaggccgaggccaactacctgcgggccctgcagctcaagccagacgatgtcatcacacagtccaatctccgcaaactgtggaacatcatggaaaaacaaggcttaaagacttctaagacctgacacaggaggcagaagcccatcctcctccatttttaaaagctggcttccttagcagacagaacttcccagcagtgctatgacaagagctggtgttagacttcaagaccagggcagaggtcattgaggtcactaccgcttctggaagaatccactttgctgtaggcacagctgttaacaccaaaaaggggaaagccggaaacctcctggaggatgtcattgttacccatagactgtaaaccagagcacttaaaacagaaccttttggcattcttaaaaagggaggggtgggtgtgtaagtcacagattttgttcattttctgaaagctaatttcaaaattatgttgttccttaaacactgtgagaggaagtcagagtgtccattcaggcatggcaaacaattagggttaagtgttacgagggagtgataaacacgtagtgtgagtcccagtgagccgccggttgtcctaacgctgctgtcttccctgtttgggacagcctgcttatcaatttctgaagcttagaacactttttttaatactgtgtcaagatctgtcagaatctgctatgtttcttgaccagtgcacataatgttttatgatttggatgtcagaggcttcattcttttggacatcatttgctttttatgttctgaaaaggatatggagagtagagctaaccatacttcacactcgagttgtatgagggactggggaggccttatatgtgtcaggcaggcattttttaaattttaatatcgtcaatattttcccccaaactgcccagtagaattcattgtattaattcttttgaaattacctttgaaaatagctattcctggagaatgtgcaagcttacataaggataaaggacaggggaggagtttgtaagccttgcagttccaataactaaccaacaggttattagacaaaagggaaggtgttttgtgcttctcagatgttgctggtttaggagtgtgtgatgatgcttgccagtgattttgtgttttggaaagggtaggtatcgaatgttaatcactttctaatgggtacctaaacagcaatgctgataaatgttcaaggaattattttcatcttagtttgttcttctcaaaaggcatcaaaaacaacttatttgaagctgcaatagagtgtagcattagcctgcatgtttctaggtcttctgccaagtgcttttctcagttgaaaactatttttcactagcaaaattggtattttatttcattacctgttagtaactacttcaatgatcatttcacaagaaaaagactataaattaagtagagaacaacatttttattgaacatttttggcttgcaatcaaactttgccactaaaaattaacttcataaaacactagtccgttatcaacttcttcacagagaaagtagctatactataccctacatatttatttatttattattctactatagcagaataacaaaacttgatgcattaagccagttctttgcaactgaaaattacctgtttctccttccctttcacactccatgtatatatgatcagcctctccattaaaaagaagctggacatgcaaatacatcatattatgttttctccatattttatgtttttctatgtatctgaatacagtgggataaataattgaaagtagtgttcctatggcattagtgtttttgtgagaagggtaaatgtagtgagaaaggttttttcatggcattaataagaaagcccttctgtaatatatatattattttgtaaacatttcactgaagggccaaaagttaaattataactaaatcactgtgttttcagaatgatatttaacaacaaacccgtggtcaaaccaaaatagtgggttgaagtgtattattcatcttttagtgcattggcaattgcaaaaaaaaaaaaggaatttaatataaggctatagagattaattcagtgtctaacatttgtatttatttaaatagttattgacctatgatgactttctagtcttaacattttatctttttattgttgttgttcttcctttcaaagatgtggttcttaataggttcactgaatgcacagttgaggcacttcttgtgacaccagttcccaagtagcgttaataattgggcctgtgtcataaaatgcacggatcattaataactaaatgtccctgacacttttcactacagggctggacttagtaactgaccaacttcggggggagggttggggcaagggggggtgggcgttagaacatgatcaaaaaatgtctccgctcagggatttatggtggattattgcagacagtgctaaaaatatagagcacaagacaagtttactaaattaaaattttattttttgagaaactgttatttgtataaattatcaagatttgtaggctttccttttgtagaaataattgttttatgtgccagagaatttcaattttgttttcaacaataaagcattgataagaaatata

SEQ ID NO: 193156 - DNA, 7203 bp, Homo sapiens
  Payload ID: 18138
  Gene Name: transmembrane and tetratricopeptide repeat containing 3
  Uniprot ID: Q6ZXV5
  ENST ID: ENST00000266712
  CDS Start-End: 221-2965
atgcaacgcgtaagactgcgacggtaccggggcggcggggaaggaccgagaggcgggaggagcagcggctcaggcgcctgcaaactggtggcctgaacgaggtagaccatgactgtggtttcagtggcgtcactcgctgggctgctcttcctgaggttttcctaagccatcccctggcggaaccgcccccagtttttgtccagaagtgcttatagaaaagatggctaatattaacctaaaagaaataaccttaatagtaggtgtggttactgcctgctattggaacagcctcttttgtggttttgtttttgatgatgtttcagcaatactggataacaaagacttgcatccatctacacctttaaaaactttatttcaaaatgacttctggggaacccctatgtctgaggagagaagccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacacacagaagcagtaacaggagttgttggaagagcagaacttttgtcatctatcttttttctagcagcttttttgtcatataccagatcaaaaggaccagacaattccataatatggactccaattgccttgacagtgtttttagtggctgttgcaacattatgtaaagaacaaggaataacagttgtaggaatttgctgtgtgtatgaagtgtttattgcccaggggtatactttgccattactatgtactactgctggacagtttctccgtggaaagggtagcattccattttctatgctgcagacactagtaaaactcattgtcttgatgttcagtacattattacttgttgtgattagagtccaggttattcaatcccaacttccagtattcaccaggtttgataacccagctgctgtaagcccaactcctacaaggcaactaacttttaactacctccttcctgtgaatgcttggttgttattaaatccttcagagctctgctgtgattggaccatgggaacaataccacttatagagtcattactagatattcgaaatctggccacatttactttcttttgttttctggggatgttgggagtattcagtatcagatactctggtgattcctccaagactgttttaatggcgctttgtttaatggcattaccatttattcctgcatcgaaccttttttttccagttggatttgttgttgccgagcgagtattatatgttcccagcatggggttctgtattttggtagcccatggatggcagaaaatatcaacaaaaagtgtatttaaaaagctatcctggatttgtctgtctatggtgatactcactcattccttaaaaacattccacagaaattgggattgggagtctgaatatacattgtttatgtcagccttgaaggtaaataaaaataatgccaaactttggaataatgtgggtcatgctctggaaaatgaaaagaactttgagagagctttgaaatacttcttacaggctacccatgttcagccagatgatattggtgcccatatgaatgtaggaagaacttataaaaatttaaatagaaccaaagaagctgaagaatcttacatgatggctaaatcactgatgcctcaaattattcctggtaaaaaatatgcagccagaattgcccctaaccacctaaatgtttatatcaatctggctaacctgatccgagcaaatgagtcccgactggaagaagcagatcagctgtaccgtcaagcaataagcatgaggcccgacttcaagcaggcttacattagcagaggagaattgcttttaaaaatgaataaacctcttaaagcaaaggaagcatatcttaaagcactagagctggacagaaataatgcagatctttggtacaacttggcaattgtacatattgaacttaaagaaccaaatgaagccctaaaaaactttaatcgtgctctggaactaaatccaaagcataaactagcattattcaactctgctatagtaatgcaagaatcaggtgaggttaaactcagacctgaagctagaaaacgacttctaagttatataaatgaagagccactagatgctaatgggtatttcaatttgggaatgcttgccatggatgacaaaaaggacaatgaagcagagatttggatgaagaaagccataaagttacaagccgacttccgaagtgctttgtttaatctggctctcctgtattcccagactgcaaaggaattaaaggctttgccaattttggaggagttactcagatactaccctgatcatatcaagggcctcattttaaaaggagacattctgatgaatcaaaagaaagatatactaggagcaaaaaaatgttttgaaaggattttggagatggatccaagcaatgtgcaaggaaaacacaatctttgtgttgtttattttgaagaaaaagacttattaaaagctgaaagatgccttcttgaaacactggcattagcaccacatgaagaatatattcagcgccatttgaatatagtcagggataagatttcctcatctagttttatagagccaatattcccaaccagtaagatttcaagtgtggaaggaaagaaaattccaactgaaagtgtaaaagaaattagaggtgaatccagacaaacacaaatagtaaaaacaagtgataataaaagtcagtctaaatccaacaaacaattaggaaaaaatggagacgaagagacaccccacaaaacaacaaaagacatcaaagaaattgagaagaaaagagttgctgctttaaaaagactagaagagattgaacgtattttaaatggtgaataacattaatatttatcgtgacaatggtatcaaagaacatcaatccgtatcatgtgattgcttttactgggagctttgaaaaaaagttcaagggttcctaatggtcaatcatgagctgccttgaagtaggatcaaaataagattttcattaaagacctgtattatcccaggatgtatattatgtatcgctgttttcagagtgtgggtgaatatagcagaaatattacagcggaagtgacaaatttacaacttttattatagaaagaaggtgtttctggcaatgtaatctttactgctctcaattaaaaataattttgaggcctgaatgataatcccttgaggacaaatccaacatgtgctggtttattctgttaattcccatttatttgcctacttcatttttcttgcacctcttagaatctaactatgaattgaaaacacttaagtaattctgtttaatcaagggatttacactacaaaagaatgctggctttttttatgttgtattccttagttgagttttagaaggaatgcttgatgaaacattttaaaataagtcatgacatgttagcttgagaatgtattttcataattgtatacttgtttttaactttaaatgtaatttttaatcaggtaaagtttgacacatgtatagctacatacacacatttttaatggtgctcatatatactgtattttttgttgtttagttttacttattgagagtgtcacaacatgaatcacataatcatgattttttttttttacttttactccccaaattattcatgtttcttagatcgtagtcattgagaagtcccaataactctaaacttttgagttataacgtagtaaacttctctttcatctttgtgttagctctgtagtcttaacctggattttaatttttttgtttccaaagtcacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaagctattttaatcatcaagtatggaaaacaaattactattgcattttcctatatatgcatatattatggattaaccagaattgtatcatttttggcctaatgtctggatataaaagataattagcctactatagtattaataaatttttcagttggtttgggcaaatttaaacctgaaaaataggttaaaaagtagttacaaattaaacttactaatttatacctgattttttttcttgaattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagatttttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggacttttaatatggaatccacctcataacaattaagtctaaatttctggaagatggagccatgcttgtttttccaaaagctctttgagtgattctaatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagtgagatggaggaggtgggcacatttaaggtcagttcactaacctatggttcagagttctgatcatatggaagtttggaaaagagagcttatcacaggtttgtatgctggtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaaccataacctggcttgccttttagtgttaaaaaaatacaacattgtatatagagatttcttttatgaagaagagctgacgtaatttattagcagtgatctgagaaagacattaaataagtttctgagagtgatacattttcaaacatgaggagtgacaaccaccaaattaagaaaaggaaacaactcagacttggaattttatacgaatttcatttctatatgtgcctggtattgcctctggcataacttagaggaaattgttctacctatatgtcctcagtttcttcatctacaagttgggaaaaacattttcctcttaaaattgtgaagaggatttatatatttatatgatatattgtatatattaatatatttaaattgcttagagtttctagcacatagcaaataataaatattagttattagtataaacataaggcttaaagtcttggatttgatgcatatgacttaatttgtatttgtgctagtagctgtaatgtcagtgacaggataacaagcaaatgattagaaatctaatagtaatgcttgttcctttgctatctatgctaacaagtacatagatagcctaagataaattatacttaggatgaagctaaaatgcataactgagacaccttaaaattgtactaccttgtgctgttcactgccatcagggaggtagcataaaatgaaagataaagtctgaagactggatccaggcaaattcatgttctttctttgtaactcactttcttcgtcaacatttctgtgactcaatggatagcatatttccatcaagtagcacgtataacgtgatgctttcatgtttctgccttaaataaaataaccctcaaaaaacca

SEQ ID NO: 193157 - DNA, 574 bp, Homo sapiens
  Payload ID: 18138
  Gene Name: transmembrane and tetratricopeptide repeat containing 3
  ENST ID: ENST00000549011
  CDS Start-End: 130-574
atgcaacgcgtaagactgcgacggtaccggggcggcggggaaggaccgagaggcgggaggagcagcggctcaggcgcctgcaaactggtggcctgaacgagtttttgtccagaagtgcttatagaaaagatggctaatattaacctaaaagaaataaccttaatagtaggtgtggttactgcctgctattggaacagcctcttttgtggttttgtttttgatgatgtttcagcaatactggataacaaagacttgcatccatctacacctttaaaaactttatttcaaaatgacttctggggaacccctatgtctgaggagagaagccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacacacagaagcagtaacaggagttgttggaagagcagaacttttgtcat

SEQ ID NO: 193158 - DNA, 646 bp, Homo sapiens
  Payload ID: 18138
  Gene Name: transmembrane and tetratricopeptide repeat containing 3
  ENST ID: ENST00000551088
  CDS Start-End: 210-646
aagactgcgacggtaccggggcggcggggaaggaccgagaggcgggaggagcagcggctcaggcgcctgcaaactggtggcctgaacgaggtagaccatgactgtggtttcagtggcgtcactcgctgggctgctcttcctgaggttttcctaagccatcccctggcggaaccgcccccagtttttgtccagaagtgcttatagaaaagatggctaatattaacctaaaagaaataaccttaatagtaggtgtggttactgcctgctattggaacagcctcttttgtggttttgtttttgatgatgtttcagcaatactggataacaaagacttgcatccatctacacctttaaaaactttatttcaaaatgacttctggggaacccctatgtctgaggtaacaggagttgttggaagagcagaacttttgtcatctatcttttttctagcagcttttttgtcatataccagatcaaaaggaccagacaattccataatatggactccaattgccttgacagtgtttttagtggctgttgcaacattatgtaaagaacaaggaataacagttgtaggaatttgctgtgtgtatgaagtgtttattgcccaggggtatactttgccattactatgtactactgctgg

SEQ ID NO: 193159 - DNA, 1842 bp, Homo sapiens
  Payload ID: 18138
  Gene Name: transmembrane and tetratricopeptide repeat containing 3
  ENST ID: ENST00000547034
  CDS Start-End: 221-1441
atgcaacgcgtaagactgcgacggtaccggggcggcggggaaggaccgagaggcgggaggagcagcggctcaggcgcctgcaaactggtggcctgaacgaggtagaccatgactgtggtttcagtggcgtcactcgctgggctgctcttcctgaggttttcctaagccatcccctggcggaaccgcccccagtttttgtccagaagtgcttatagaaaagatggctaatattaacctaaaagaaataaccttaatagtaggtgtggttactgcctgctattggaacagcctcttttgtggttttgtttttgatgatgtttcagcaatactggataacaaagacttgcatccatctacacctttaaaaactttatttcaaaatgacttctggggaacccctatgtctgaggagagaagccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacacacagaagcagtaacaggagttgttggaagagcagaacttttgtcatctatcttttttctagcagcttttttgtcatataccagatcaaaaggaccagacaattccataatatggactccaattgccttgacagtgtttttagtggctgttgcaacattatgtaaagaacaaggaataacagttgtaggaatttgctgtgtgtatgaagtgtttattgcccaggggtatactttgccattactatgtactactgctggacagtttctccgtggaaagggtagcattccattttctatgctgcagacactagtaaaactcattgtcttgatgttcagtacattattacttgttgtgattagagtccaggttattcaatcccaacttccagtattcaccaggtttgataacccagctgctgtaagcccaactcctacaaggcaactaacttttaactacctccttcctgtgaatgcttggttgttattaaatccttcagagctctgctgtgattggaccatgggaacaataccacttatagagtcattactagatattcgaaatctggccacatttactttcttttgttttctggggatgttgggagtattcagtatcagatactctggtgattcctccaagactgttttaatggcgctttgtttaatggcattaccatttattcctgcatcgaaccttttttttccagttggatttgttgttgccgagcgagtattatatgttcccagcatggggttctgtattttggtagcccatggatggcagaaaatatcaacaaaaagcctgagacagaacaaactttgagtcagatccaaatgaaaacaaggatgttactgagaataaagtctcaaatgaccattgccacttccatattcagtgaactaagataatagtcatcctacttaatgtatttaaaaagctatcctggatttgtctgtctatggtgatactcactcattccttaaaaacattccacagaaattgggattgggagtctgaatatacattgtttatgtcagccttgaaggtaaataaaaataatgccaaactttggaataatgtgggtcatgctctggaaaatgaaaagaactttgagagagctttgaaatacttcttacaggctacccatgttcagccagatgatattggtgcccatatgaatgtaggaagaacttataaaaatttaaatagaaccaaagaagctg

SEQ ID NO: 193160 - DNA, 3602 bp, Homo sapiens
  Payload ID: 18139
  Gene Name: transmembrane and tetratricopeptide repeat containing 4
  Uniprot ID: Q5T4D3
  ENST ID: ENST00000342624
  CDS Start-End: 260-2542
agagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagc

SEQ ID NO: 193161 - DNA, 3483 bp, Homo sapiens
  Payload ID: 18139
  Gene Name: transmembrane and tetratricopeptide repeat containing 4
  Uniprot ID: Q5T4D3
  ENST ID: ENST00000376234
  CDS Start-End: 191-2416
gcgggaggcgcggcgcggggggggtcgggtgcgcggcgggcggcccctccccctgccaggtccgggcgggtgcctggagccgccagagtttccgcacccgggagggagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagcatgaaaa

SEQ ID NO: 193162 - DNA, 2101 bp, Homo sapiens
  Payload ID: 18139
  Gene Name: transmembrane and tetratricopeptide repeat containing 4
  Uniprot ID: Q5T4D3
  ENST ID: ENST00000328767
  CDS Start-End: 86-1978
gagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatg

SEQ ID NO: 193163 - DNA, 584 bp, Homo sapiens
  Payload ID: 18139
  Gene Name: transmembrane and tetratricopeptide repeat containing 4
  ENST ID: ENST00000440120
  CDS Start-End: 107-451
agagtttccgcacccgggagggagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataagcacaccctgctgtggaggctccacttaatcaaatatttagaacctcgttggtgttcatttcctgttcaaagggaggaaaagatcctctgccgaagcccttcacagctgaccgggtacttctgtaagagtgtagaagaaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctc

SEQ ID NO: 193164 - DNA, 639 bp, Homo sapiens
  Payload ID: 18139
  Gene Name: transmembrane and tetratricopeptide repeat containing 4
  ENST ID: ENST00000423847
  CDS Start-End: 478-639
gcgggaggcgcggcgcggggggggtcgggtgcgcggcgggcggcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatggtgtgtcccgttgcctgttggatctgtctccatcttcactcagacagaaggctatagaaagatgcctgtgacttcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataag

SEQ ID NO: 193165 - DNA, 580 bp, Homo sapiens
  Payload ID: 18139
  Gene Name: transmembrane and tetratricopeptide repeat containing 4
  ENST ID: ENST00000475272
  CDS Start-End: 362-580
aacccggcttcctcctctcccgccgggtccgtctgtccctgcgcctccttcgccgccgactagcgccccctggcctgacgtcaccggcgcgtccgccaatgagctgaggagggacttggctgtggcctgaaagtgacgggagcagcagccaatgttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataag

SEQ ID NO: 193166 - DNA, 1353 bp, Homo sapiens
  Payload ID: 18140
  Gene Name: transmembrane and ubiquitin-like domain containing 1
  Uniprot ID: Q9BVT8
  ENST ID: ENST00000297533
  CDS Start-End: 144-884
aatgccccgggccgcggcggcggggaaggaggggtgcttcaggtgcctgcgacctccgcgcctcccgcccggaagtgcccgaggggccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcactctt

SEQ ID NO: 193167 - DNA, 1563 bp, Homo sapiens
  Payload ID: 18140
  Gene Name: transmembrane and ubiquitin-like domain containing 1
  Uniprot ID: Q9BVT8
  ENST ID: ENST00000392818
  CDS Start-End: 359-1099
gtgccgcgggtggggtttaggtgaaccgtaacgcggggggcgggggtgggggcacagaggctctacccccacctcttagaaactttagcagcggagtagatgagcctggggtgaagtcggtgaaggagtagacacactggggtgaagtgggcaggagaatagatacgcttgggggtgaagtttggttggggtgaagtttaggagaggcgttgcttaggcccttaccttgggatagggtttgggtgagttgggagctggttgaagacctcgagctcagatgacagaaagttaggacttgggattcggcgatgggaaggggcacccggagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 193168 - DNA, 1549 bp, Homo sapiens
  Payload ID: 18140
  Gene Name: transmembrane and ubiquitin-like domain containing 1
  Uniprot ID: Q9BVT8
  ENST ID: ENST00000462940
  CDS Start-End: 346-1086
ggttggggtgaagtttaggagaggcgttgcttaggcccttaccttgggatagggtttgggtgagttgggagctggttgaagacctcgagctcagatgacagaaagttaggacttgggattcggcgatgggaaggggcacccggaggcaagtttggggcgactgggaggcagagaagccggtaccctggggtgggtgaggggacggaggctgaggacggtgggagcgtcgcggtggggtgagggcaggaccctgtggaggttccagggctcctggccagggggcccgggcctcacgggctctttgtgcctctccagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttc

SEQ ID NO: 193169 - DNA, 899 bp, Homo sapiens
  Payload ID: 18140
  Gene Name: transmembrane and ubiquitin-like domain containing 1
  Uniprot ID: Q9BVT8
  ENST ID: ENST00000482202
  CDS Start-End: 94-834
ccgcccagggccccggtcgggccgggatcgccgtgccctcctgcggcttcggggggcgggaagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcggg

SEQ ID NO: 193170 - DNA, 882 bp, Homo sapiens
  Payload ID: 18140
  Gene Name: transmembrane and ubiquitin-like domain containing 1
  Uniprot ID: Q9BVT8
  ENST ID: ENST00000476627
  CDS Start-End: 89-829
gcgcggagttagtcctccgcggagtggggttgaggggacctggagggggccgagctggctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccg

SEQ ID NO: 193171 - DNA, 550 bp, Homo sapiens
  Payload ID: 18140
  Gene Name: transmembrane and ubiquitin-like domain containing 1
  ENST ID: ENST00000492838
  CDS Start-End: 95-550
gtgaagtcggtgaaggagtagacacactggggtgaagtgggcaggagaatagatacgcttggggctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgac

SEQ ID NO: 193172 - DNA, 584 bp, Homo sapiens
  Payload ID: 18140
  Gene Name: transmembrane and ubiquitin-like domain containing 1
  ENST ID: ENST00000488752
  CDS Start-End: 73-584
gtttgctgtgggggaagcctgggaagcagtcctgtgccgcggctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgt

SEQ ID NO: 193173 - DNA, 2418 bp, Homo sapiens
  Payload ID: 18141
  Gene Name: transmembrane and ubiquitin-like domain containing 2
  Uniprot ID: Q71RG4
  ENST ID: ENST00000319511
  CDS Start-End: 651-1556
cccgccccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaataacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtc

SEQ ID NO: 193174 - DNA, 1921 bp, Homo sapiens
  Payload ID: 18141
  Gene Name: transmembrane and ubiquitin-like domain containing 2
  Uniprot ID: Q71RG4
  ENST ID: ENST00000357984
  CDS Start-End: 150-1055
gaagccggaagagaccggaccctgaacagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgc

SEQ ID NO: 193175 - DNA, 1580 bp, Homo sapiens
  Payload ID: 18141
  Gene Name: transmembrane and ubiquitin-like domain containing 2
  ENST ID: ENST00000446571
  CDS Start-End: 424-1218
ataacagcttccgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcaccca

SEQ ID NO: 193176 - DNA, 1953 bp, Homo sapiens
  Payload ID: 18141
  Gene Name: transmembrane and ubiquitin-like domain containing 2
  Uniprot ID: Q71RG4
  ENST ID: ENST00000538716
  CDS Start-End: 154-1119
ccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctg

SEQ ID NO: 193177 - DNA, 1569 bp, Homo sapiens
  Payload ID: 18141
  Gene Name: transmembrane and ubiquitin-like domain containing 2
  Uniprot ID: Q71RG4
  ENST ID: ENST00000590235
  CDS Start-End: 86-370
ggaaagacgagtccaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgca

SEQ ID NO: 193178 - DNA, 546 bp, Homo sapiens
  Payload ID: 18141
  Gene Name: transmembrane and ubiquitin-like domain containing 2
  ENST ID: ENST00000587775
  CDS Start-End: 191-376
cattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggcgacacatccgtcctccacctggggcatgtggaccacctggtggcaggccaaggcaaccccgagccaactgaactcccccatccatcagaggacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcc

SEQ ID NO: 193179 - DNA, 1598 bp, Homo sapiens
  Payload ID: 18141
  Gene Name: transmembrane and ubiquitin-like domain containing 2
  Uniprot ID: Q71RG4
  ENST ID: ENST00000587172
  CDS Start-End: 115-399
agggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgca

SEQ ID NO: 193180 - DNA, 747 bp, Homo sapiens
  Payload ID: 18141
  Gene Name: transmembrane and ubiquitin-like domain containing 2
  ENST ID: ENST00000588413
  CDS Start-End: 224-409
ggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacgcgtggaccctgccagcagccaggccatggagctctctgatgtcaccctcattgagggtgtgggtaatgaggcgacacatccgtcctccacctggggcatgtggaccacctggtggcaggccaaggcaaccccgagccaactgaactcccccatccatcagaggacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatgg

SEQ ID NO: 193181 - DNA, 1191 bp, Homo sapiens
  Payload ID: 18141
  Gene Name: transmembrane and ubiquitin-like domain containing 2
  ENST ID: ENST00000587630
  CDS Start-End: 1-583
tggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtca

SEQ ID NO: 193182 - DNA, 2151 bp, Homo sapiens
  Payload ID: 18141
  Gene Name: transmembrane and ubiquitin-like domain containing 2
  Uniprot ID: Q71RG4
  ENST ID: ENST00000592825
  CDS Start-End: 688-972
ccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaataacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaag

SEQ ID NO: 193183 - DNA, 1969 bp, Homo sapiens
  Payload ID: 18141
  Gene Name: transmembrane and ubiquitin-like domain containing 2
  Uniprot ID: Q71RG4
  ENST ID: ENST00000587989
  CDS Start-End: 154-1119
cggaaagacgagtccaggggccgtcctggcgaggtcaaaacatttagtctggtcttttcaggggttagttgtggttgtgataaataattactaccgttattaagcaattgcaatttgcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttc

SEQ ID NO: 193184 - DNA, 1918 bp, Homo sapiens
  Payload ID: 18141
  Gene Name: transmembrane and ubiquitin-like domain containing 2
  Uniprot ID: Q71RG4
  ENST ID: ENST00000589785
  CDS Start-End: 165-1070
tcctcactggccgggacaactggtcttatcacggaggctggggccaggcagcccttcggttcgggtgggcccatggaccccagtccaacgccgagggaataggaccatccaaaagcggaaccttcgcctcagaaaaaggcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagt

SEQ ID NO: 193185 - DNA, 1839 bp, Homo sapiens
  Payload ID: 18141
  Gene Name: transmembrane and ubiquitin-like domain containing 2
  ENST ID: ENST00000587326
  CDS Start-End: 197-490
tttaggtttaggttggggtgccggaattaggaaggtttgtgcccccttctacacaacactgaactccttttttttttttttcagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagaggacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggt

SEQ ID NO: 193186 - DNA, 1505 bp, Homo sapiens
  Payload ID: 18141
  Gene Name: transmembrane and ubiquitin-like domain containing 2
  Uniprot ID: Q71RG4
  ENST ID: ENST00000589856
  CDS Start-End: 203-748
attaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagaggtgagtggcctgggaagtgggaagctgcttgtgctcatcccccagcccttggttgcctctaaggaggctggtgcagacatgggagctgcagcaaagtgtaagatccagcccctaccaagggcaggtagatactttcttagaaatacacccttcaggccgggtgcagtggctcccgggactttgggaggccgaggcgggtgcatcacgaggttaggagttcgagaccagcctgaccaacatggtgaaaccccatctctactaaacatacaaaaatcagccgggcgtggtggcgcacgcctgcaatcccagctactcaggaggctgaggcaggagaatcgcttgaacccaggaggtggaggttgcagtgagccgagattgcgccactgcactccagcctgggcgacagagtgagactccatctaaaaaaacaaaacaaacaaatacacccctcattagttaaggataaagatgaggggggcctgtcgcggtggctcacgcctgtaatcccagcactttgggaggccaaggcgggcagatcacaaggtcaagatatcaagaccatcctggccagcatggtgaaaccctgtctctactaaaaaaaaaaatacaaaaattagctgggcatggtggcgcactcctgtagtcccagctactcgggagggtgaggcaggagaattgcttgaacccgggaggcagaggttgcagtgagccgagatcgcgccactgcactccagcctggcaacagagtgagactccgtctc

SEQ ID NO: 193187 - DNA, 1837 bp, Homo sapiens
  Payload ID: 18141
  Gene Name: transmembrane and ubiquitin-like domain containing 2
  ENST ID: ENST00000589184
  CDS Start-End: 582-809
ggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaataacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaag

SEQ ID NO: 193188 - DNA, 4591 bp, Homo sapiens
  Payload ID: 18142
  Gene Name: transmembrane anterior posterior transformation 1
  Uniprot ID: Q6NXT6
  ENST ID: ENST00000405303
  CDS Start-End: 85-1788
gaggggcggggcgaggcggggagggggccggccggaggcagaggctggagggaggcggcggggacagtttgttgtgctcggaacatggcgggcgtcggcgacgcggccgctccgggagaaggcggcggtggcggcgtggacggcccgcagcgggacggccgcggcgaggcggagcagccgggcggcagcggcggacaggggcccccgccggcgcctcagctcacagagacgctgggcttctacgagagcgaccggcggcgggagaggcgccggggccgcacagagctttcattgttgaggttcctcagtgctgaactaacaagagggtacttccttgaacataatgaggccaagtatacagaaagaagagaaagagtatacacttgtttgcgaataccaagagaattggaaaagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagtgctgtgttgccaggacaaatagatgctaaacatggcacttaaatatttatttaaaaacttaaattattattggcaagcaaatcttagtatctttcttccagtaatatggcctggctgagggtcagaccacaggacaggagcgacctccggccttgactgtctgggaagcttgatggattataaaacttcctcctgcctggccaagcagcagcatcatttccaggacccaacaaaggcaacatcaaaatctgttttgctttgtcagtctgggcttccagaatgttgaatttgcctcaaggcctcttcagtataaggaaatacctggaaaactgtgaaacttttaccacgacgtaatctttccagtctcatactattttcacaaacagttttcaaacgttacttcatctgccaaagcattaaaaaaattaaacataagtcaagataaatgttcttaccaccagaataacccttaaagatgtatcttaattaatcagaataaaaggctaccttaaataagacatgatgaatagtagcattttgtagggttaaaaaaaaatgctaaactagtttatttattaaaaaaataattaatgaaggctatgcattactgggaaaaatccttcataatttttcagtttactctttaaagcaaaatgtgagctgtatgtcatttaattggtggataaaacaaatttccttacaaaagggcactttttacaccaaggaagcagagcagtgttaactttaaggtatacttaactgattttgctttaaaactaattacttcataaattattacagctaaaaggattcgatgttgaacaggctgaaaaattgtcaatgtacaaaattcaaaactgtcaactttaactgtaaagtaaatgctccaagtgtgttagacagcatcatcttgcttgggcttaccaaatgcattagtctttgtgtttgggtcgacagcgagtgtgcctgtgctggggcagggtgtgtgttctgtgggagggtgtctgtggggatgtgactatcagggtgggcctgtgctggggatggggcaggcctgggtctggagaggattttgtgtgaaagtaaatggggtgtttgaggcgtatgggtggctgttggtgtggggaggcatctgtgtatggctgttgggaacagcaaccaaaaggtgctttttggttttatttgagatgaagattgtgtttccgcttaattactagtttgtggtctatatcatagaagttatttcccaccccattttatcttgacaaccgtgtttgcatttctgtaaaacttctacaacttctggtgtcagaactgtccagaagatggtactgttaactgttatttcctttgatgttttgattttgaagtttagctctcatgcaaatgtttcaggcgtacatacataggcagaaagcaatttttaggtgatttgtctgtttcttggatgaaatataaagcaagctttaatgttctgacttgttcatttgaaatacaaaaaagtaagtgaattttaatgttttgcattaactaaagaaatctgaagattaatgttgaggaaattgtatggacatgcctttgtgaaaccaggaagtattttaagttaaaaatgaaaaaggttttaattgctttgtgtgtgttttaatggagccccattttagaattattttttccatctccctttaccaacaaaaggaacaatgccaccgtgaatggaatagtttggggaaagctttgccaaacacaaccctgatttcagagcaggaacatggtttggatagatcttcagttccgcttgaattattctgttactgcgctgtcattttcagaagatttccattcctttgcagatgctgttgggagttcgggattatgttcatttcttctgttttaatggcattcagtactaattttataagtgcatcttgtgtgaatctcaataaattcagttttgtaatcttttttaaaaaggtcactgaatttattttaatatttactattgtatttggtagagtgaatttcccactgtataataagtatttatttgtaattcacaagtgatagagctatcttaatttgaattattgctttggtcttaatggtggcaaaatgtttaattttgtctttggaaaaaataggctcggccttgattatagaccatttaatatttctcagcaaatgaaggtatttgcattttacaagtgttttgaatgtcacacaaaatatttttcacatctgggagtcaagttcaagacagtgctttggttttaaaaaaatctaatgaaggcacaggataggccagacccttattaggttttcctttagaataagtgtaaagaccaagtgtcactgatacgcttgtccagattttcttgtggactttggccagtatttagagtttatattcatgttacataaagtgaaagaaacttgctataattaggccatcaaaatatatcctgccactcctggtaactcagcagaggaggagataaatttacaaaataatgtaatatctctacattgttacatgttttcaactattttttatcaacaaagatttgttaatcacttcctatgtgtcagaaactgttctaagtggtgggatcagcaatgagcaagataagtccctgttcgtctgtggaagactgataggaacaagtcgatgaaataatgtctgctggtcacagagtgtccactgaccaaatgatctctcaggcttatttcagctctaaaatatagttctttaaaacgtt

SEQ ID NO: 193189 - DNA, 1634 bp, Homo sapiens
  Payload ID: 18142
  Gene Name: transmembrane anterior posterior transformation 1
  ENST ID: ENST00000505603
  CDS Start-End: 15-368
gttgtgctcggaacatggcgggcgtcggcgacgcggccgctccgggagaaggcggcggtggcggcgtggacggcccgcagcgggacggccgcggcgaggcggagcagccgggcggcagcggcggacaggggcccccgccggcgcctcagctcacagagacgctgggcttctacgagagcgaccggcggcgggagaggcgccggggccgcacagctgatggtttttggaatctttctgtgcctggatgcgtttttgtatgtgttcaccctgcttcctttaagagttttcctggcactattcaggctcctcactttgccttgctatggcttaagggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattggggtgattcctcactttttcatggctgttctctatgtctttttgcatgcaattcttataatggttcaagcaacaactctcaatgtagcttttaactcacacaacaagtctttgcttactatcatgatgtctaataattttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttactcatcagagttgtaacaagctcaattaaagtgcaaggaatcctgtcttatgcctgtgtcatactcttctattttgggttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttcatgcgctgaagaagctgggtcctggggcaacaagt

SEQ ID NO: 193190 - DNA, 431 bp, Homo sapiens
  Payload ID: 18142
  Gene Name: transmembrane anterior posterior transformation 1
  ENST ID: ENST00000513833
  CDS Start-End: 1-155
agctgatggtttttggaatctttctgtgcctggatgcgtttttgtatgtgttcaccctgcttcctttaagagttttcctggcactattcaggctcctcactttgccttgctatggcttaagaccgaagggaggagcactttcacttcctttatagaatggaatgtggtggcacagggactccttgtgggacagacgtttgcttcagcctgcccaggtgtgtgacattttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaaga

SEQ ID NO: 193191 - DNA, 1016 bp, Homo sapiens
  Payload ID: 18142
  Gene Name: transmembrane anterior posterior transformation 1
  ENST ID: ENST00000513782
  CDS Start-End: 1-637
tttgaagggtgtcattttggtaatctgctattttatgatgcactatgttgactactccatgatgtaccacctgataagggggcagtccgtcatcaagctctacatcatctacaacatgctggaggtagctgatcgtctgttttcatcttttggacaagacatattagatgctctctattggacagcaacagagcctaaagaaagaaaaagagcccacattgggtttgttgaaattaaaggaagtgttttcaagaagtttgaaaagaacaatctctttcaaatgtcaaatagcgatattaaggaacgattcacaaattatgtgcttttactgatagtgtgtctaagaaacatggaacagttttcttggaatccagatcatctctgggtgttgtttccagatgtctgtatggtaattgcatcagaaattgccgtggatattgtaaaacatgcctttattactaaattcaatgacattactgcagatgtctacagtgaatatagagccagtcttgcttttgaccttgttagcagccgacagaaaaatgcatacactgattacagtgactctgtagcacggaggatgggctttattcctctcccactagctgttttagttgatatccctgaaagtacttaatagcatcgtgctgttggggaaatcgtgccagtatgtgaaggaagccaaaatggaagagaagctgtcgaatcctcccgcaacctgcactccaggcaagccgtccagtaaatcacagaacaaatgtaaaccctctcaaggcctttccacagaagaaaacctgtctgcctccatcaccaaacaacctattcatcaaaaggaaaatatcataccattacttgtgacaagcaattctgatcagtttttgacaactccagatggtgacgagaaggacataacgcaggacaattctgaattaaaacacagatcctcaaagaaagatttgttagagatagacaggttcacaatttgtggaaaccgaattgactgaatctgtggcttc

SEQ ID NO: 193192 - DNA, 2371 bp, Homo sapiens
  Payload ID: 18143
  Gene Name: transmembrane BAX inhibitor motif containing 1
  Uniprot ID: Q969X1
  ENST ID: ENST00000258412
  CDS Start-End: 153-1088
gaggccggcgcgacggggcggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagttaaaaccctg

SEQ ID NO: 193193 - DNA, 2422 bp, Homo sapiens
  Payload ID: 18143
  Gene Name: transmembrane BAX inhibitor motif containing 1
  Uniprot ID: Q969X1
  ENST ID: ENST00000396809
  CDS Start-End: 213-1148
atgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagtt

SEQ ID NO: 193194 - DNA, 464 bp, Homo sapiens
  Payload ID: 18143
  Gene Name: transmembrane BAX inhibitor motif containing 1
  ENST ID: ENST00000451181
  CDS Start-End: 246-464
ggattcctgcagctagttcatgaacccaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctat

SEQ ID NO: 193195 - DNA, 534 bp, Homo sapiens
  Payload ID: 18143
  Gene Name: transmembrane BAX inhibitor motif containing 1
  ENST ID: ENST00000453281
  CDS Start-End: 283-534
ctagccctgcccggccccggaggacttgcaacactccgaggccaggaacgctccgtctggaacggcgcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttc

SEQ ID NO: 193196 - DNA, 569 bp, Homo sapiens
  Payload ID: 18143
  Gene Name: transmembrane BAX inhibitor motif containing 1
  ENST ID: ENST00000425694
  CDS Start-End: 68-569
gattgcttttctcctctcccatttcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgc

SEQ ID NO: 193197 - DNA, 677 bp, Homo sapiens
  Payload ID: 18143
  Gene Name: transmembrane BAX inhibitor motif containing 1
  ENST ID: ENST00000429501
  CDS Start-End: 165-677
tttctccactgtggctcccataaacaagtccctactcctttcccccacgtgggctgatttagggataaaaggaggccaggggaggtcatttgcctggattcctgcagctagttcatgaacccaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgacccttttt

SEQ ID NO: 193198 - DNA, 1251 bp, Homo sapiens
  Payload ID: 18143
  Gene Name: transmembrane BAX inhibitor motif containing 1
  ENST ID: ENST00000445635
  CDS Start-End: 369-782
gacttgcaacactccgaggccaggaacgctccgtctggaacggcgcaggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctg

SEQ ID NO: 193199 - DNA, 571 bp, Homo sapiens
  Payload ID: 18143
  Gene Name: transmembrane BAX inhibitor motif containing 1
  ENST ID: ENST00000444000
  CDS Start-End: 302-571
aaacccatgacgaagaagagggctgttctggggtggagcaggaactttcttggctctggggtttccttgtctgtcaaatgaccaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggat

SEQ ID NO: 193200 - DNA, 992 bp, Homo sapiens
  Payload ID: 18143
  Gene Name: transmembrane BAX inhibitor motif containing 1
  ENST ID: ENST00000437694
  CDS Start-End: 79-726
actccgaggccaggaacgctccgtctggaacggcgcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaagggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttcc

SEQ ID NO: 193201 - DNA, 580 bp, Homo sapiens
  Payload ID: 18143
  Gene Name: transmembrane BAX inhibitor motif containing 1
  ENST ID: ENST00000434015
  CDS Start-End: 379-580
ctgcccggccccggaggacttgcaacactccgaggccaggaacgctccgtctggaacggcgcaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacg

SEQ ID NO: 193202 - DNA, 589 bp, Homo sapiens
  Payload ID: 18143
  Gene Name: transmembrane BAX inhibitor motif containing 1
  ENST ID: ENST00000418569
  CDS Start-End: 138-589
aagggaagttccaaacccatgacgaagaagagggctgttctggggtggagcaggaactttcttggctctggggtttccttgtctgtcaaatgaccaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatcct

SEQ ID NO: 193203 - DNA, 348 bp, Homo sapiens
  Payload ID: 18143
  Gene Name: transmembrane BAX inhibitor motif containing 1
  ENST ID: ENST00000413976
  CDS Start-End: 211-348
gacttgcaacactccgaggccaggaacgctccgtctggaacggcgcagatggagtctcactctgttgcccaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggc

SEQ ID NO: 193204 - DNA, 2936 bp, Homo sapiens
  Payload ID: 18143
  Gene Name: transmembrane BAX inhibitor motif containing 1
  Uniprot ID: Q969X1
  ENST ID: ENST00000444881
  CDS Start-End: 727-1662
atccgtctctggcagggaggagggcaggctgcctggaccagtcagctgctcctttccatccctccctccagtacacatactctcctcttgctgtaaccccagtagctcaggcctcctctgcagattccggagccttaacccttcaaatacccccaggagagccccagccggggcctcagtaggcagacagcaggattaccacactgagagggctccaggggaggaggtgcttccgcctctgcatctgaaaaccttgacacccagcaagtcctgctgtctgagctcacccacttgtgccgctgctgtggtagaaagcaggggctctggttccttcctaatgggggactggggccctgagagaggagcaaacttagatctataatgggcaaggatagggcacagtctgaatgccttgataacaggcattgtgaggcaaggaagaatgttctaatcgagctgtctgcagacaaggggcttgctccatgttgctggagttccttcaagcagaaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagtt

SEQ ID NO: 193205 - DNA, 526 bp, Homo sapiens
  Payload ID: 18143
  Gene Name: transmembrane BAX inhibitor motif containing 1
  ENST ID: ENST00000444183
  CDS Start-End: 208-526
tagccctgcccggccccggaggacttgcaacactccgaggccaggaacgctccgtctggaacggcgcaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatct

SEQ ID NO: 193206 - DNA, 561 bp, Homo sapiens
  Payload ID: 18143
  Gene Name: transmembrane BAX inhibitor motif containing 1
  ENST ID: ENST00000453776
  CDS Start-End: 287-561
ctctagcctccacccttagacatagctacgaaagtaaacactgaccctttccccctttgctgctacctaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccg

SEQ ID NO: 193207 - DNA, 659 bp, Homo sapiens
  Payload ID: 18143
  Gene Name: transmembrane BAX inhibitor motif containing 1
  ENST ID: ENST00000440422
  CDS Start-End: 338-659
ccgccccacgaggccggcgcgacggggcggggcgcggagccccagccgagcctagccctgcccggccccggaggacttgcaacactccgaggccaggaacgctccgtctggaacggcgcaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccg

SEQ ID NO: 193208 - DNA, 361 bp, Homo sapiens
  Payload ID: 18143
  Gene Name: transmembrane BAX inhibitor motif containing 1
  ENST ID: ENST00000420341
  CDS Start-End: 338-361
tagccctgcccggccccggaggacttgcaacactccgaggccaggaacgctccgtctggaacggcgcagaggtgcaccctgaggaggtgctgggacacgtcatggtgacatcacggttggggtttctgcccacagagcctttccggccagtgcttttttttttttttcttttgagatggagtctcactctgttgcccaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccacca

SEQ ID NO: 193209 - DNA, 631 bp, Homo sapiens
  Payload ID: 18143
  Gene Name: transmembrane BAX inhibitor motif containing 1
  ENST ID: ENST00000439306
  CDS Start-End: 41-463
gtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctaacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtg

SEQ ID NO: 193210 - DNA, 989 bp, Homo sapiens
  Payload ID: 18144
  Gene Name: transmembrane BAX inhibitor motif containing 4
  ENST ID: ENST00000286424
  CDS Start-End: 12-869
ctgttgccatcatggctgaccccgacccccggtaccctcgctcctcgatcgaggacgacttcaactatggcagcagcgtggcctccgccaccgtgcacatccgaatggttctccagagagattgtaccttcagcaaacaatatatgaggataccttctgcaccctcagccacactgaatatcatcagattttttcatctccggcaatctggtagatcagggatggtgaacattttctacaaagggccaacctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatg

SEQ ID NO: 193211 - DNA, 2952 bp, Homo sapiens
  Payload ID: 18144
  Gene Name: transmembrane BAX inhibitor motif containing 4
  Uniprot ID: Q9HC24
  ENST ID: ENST00000358230
  CDS Start-End: 122-838
ctcgctcggtgttcgcccgccgacgccgcacggcttgctggggctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcagttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtcttatggtttcatttgtgttggtccacacagcatgttaggtcagtgtaccagtaaccaatgaaattttgtcaaattccctcactgtactagtttgttaggctgccataacaaagttctacagcttgggtggcttcaacaagaaatttgttttcccacagttctggaggctaaaagtccaagatcaaggtgttagcagggttggtttcctttgaggcctttctctttgatttgtagatggccatcttctccctgtgtctttaaatggccttccctctgtacttgtctgtgcccaaatttcttcttcttatgaggacaccagtcatactggattagggcccacactgaggacctcatttttccttaattatctctttcaaaacctatctccaaatacagtcacattctgaagtgctgggattaggatttcttcatgtgaattttggggggactacaactcagcccataacaccccctaagtatttcccagctattaagttgaaataaacttgtagtatcaatttaagcttgcatgatttgtagatgtaaatttgactttattatcattaactgttgaattatcaagtgtatgatgcagtgcaatcaagtttaacagcatggtgggtaagagcatctagattagaatcattgcagtccaaccaggtgcttaagtgacatttggcgaattatttatccttccttaggtcttctgcctcatcttcataatgggaataatgatgtctagcttattgggctgttataaggattaaatgagatagataaataaactaaactaagtgcttaattaatgtcagctgatggtattaataccattttctttttttttttttttttttttttttaatttatttttttattgataattcttggttgtttctcacagagggggatttggcagggtcatgggacaatagtggagggaaggtcagcagataaacaagtgaacaaaggtctctggttttcctaggcagaggaccctgcagccttccgcagtgtttgtgtccctgattacttgagattagggattggtgatgactcttaacgagcatgctgccttcaagcatctgt

SEQ ID NO: 193212 - DNA, 844 bp, Homo sapiens
  Payload ID: 18144
  Gene Name: transmembrane BAX inhibitor motif containing 4
  ENST ID: ENST00000398033
  CDS Start-End: 48-533
gcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcaggttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaa

SEQ ID NO: 193213 - DNA, 409 bp, Homo sapiens
  Payload ID: 18144
  Gene Name: transmembrane BAX inhibitor motif containing 4
  ENST ID: ENST00000545504
  CDS Start-End: 54-197
gaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttct

SEQ ID NO: 193214 - DNA, 571 bp, Homo sapiens
  Payload ID: 18144
  Gene Name: transmembrane BAX inhibitor motif containing 4
  ENST ID: ENST00000534930
  CDS Start-End: 19-150
aggggtgctgttgccatcatggctgaccccgacccccggtaccctcgctcctcgatcgaggacgacttcaactatggcagcagcgtggcctccgccaccgtgcacatccgaatggggcccagaatgcaacaggtctttgaggattattgaggaagttgctcaacacagaagcttcctaacctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattg

SEQ ID NO: 193215 - DNA, 1303 bp, Homo sapiens
  Payload ID: 18144
  Gene Name: transmembrane BAX inhibitor motif containing 4
  ENST ID: ENST00000545407
  CDS Start-End: 30-161
ccgggaccggtaggggtgctgttgccatcatggctgaccccgacccccggtaccctcgctcctcgatcgaggacgacttcaactatggcagcagcgtggcctccgccaccgtgcacatccgaatggggcccagaatgcaacaggtctttgaggattattgaggaagttgctcaacacagaagcttcctaagtcagtctaaattgtgttttaagttattacgtagtagccaatgggcagaaatttttgaatttaaaatgctcagcttcatctacgtggaagccattgcctgctctagtttggtcatttgatcgccgaaacagccccagactttcagcctgtttaggcagctggaacttgttctggaaaaggaaagatgaagatagttctgatgtgctaagaatcttagtgcctagaacttgttctggaaaaggaaagatgaagatagttctgatgcaccaagaatcttggtgcctagcatttatatttttggaattgaattttgaaattattttggccagtgaactcagcttttttttaaaaaaaattaattgtggtaaaatacagcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaa

SEQ ID NO: 193216 - DNA, 770 bp, Homo sapiens
  Payload ID: 18144
  Gene Name: transmembrane BAX inhibitor motif containing 4
  ENST ID: ENST00000542724
  CDS Start-End: 49-537
ggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaa

SEQ ID NO: 193217 - DNA, 2240 bp, Homo sapiens
  Payload ID: 18144
  Gene Name: transmembrane BAX inhibitor motif containing 4
  ENST ID: ENST00000544599
  CDS Start-End: 1032-1217
gtcgtggaaatgagtcggttgatcactgtgactgacgtacacacgagtggaatccacggcctgatgtttttgttctgtggggtttcgcgttacaggcttatatttaccgtcctgtgctaggctggaagctccctgacggcactatttcctctccgcagggcccagaatgcaacaggtctttgaggattattgaggaagttgctcaacacagaagcttcctaagtcagtctaaattgtgttttaagttattacgtagtagccaatgggcagaaatttttgaatttaaaatgctcagcttcatctacgtggaagccattgcctgctctagtttggtcatttgatcgccgaaacagccccagactttcagcctgtttaggcagctggaacttgttctggaaaaggaaagatgaagatagttctgatgtgctaagaatcttagtgcctagaacttgttctggaaaaggaaagatgaagatagttctgatgcaccaagaatcttggtgcctagcatttatatttttggaattgaattttgaaattattttggccagtgaactcagcttttttttaaaaaaaattaattgtggtaaaatacagcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcagttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagta

SEQ ID NO: 193218 - DNA, 610 bp, Homo sapiens
  Payload ID: 18144
  Gene Name: transmembrane BAX inhibitor motif containing 4
  ENST ID: ENST00000556010
  CDS Start-End: 122-610
ctcgctcggtgttcgcccgccgacgccgcacggcttgctggggctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggattatggatattttctttctttaa

SEQ ID NO: 193219 - DNA, 851 bp, Homo sapiens
  Payload ID: 18144
  Gene Name: transmembrane BAX inhibitor motif containing 4
  ENST ID: ENST00000613669
  CDS Start-End: 13-645
gctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgcctgtcaggattcttgaagtttttttttatagtgagataatggagttggtcttagccgctgcaggagcccttcttttctgtggattcatcatctatgacacacactcactgatgcataaactgtcacctaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaa

SEQ ID NO: 193220 - DNA, 766 bp, Homo sapiens
  Payload ID: 18144
  Gene Name: transmembrane BAX inhibitor motif containing 4
  ENST ID: ENST00000535812
  CDS Start-End: 62-193
gaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggggcccagaatgcaacaggtctttgaggattattgaggaagttgctcaacacagaagcttcctaagtcagtctaaattgtgttttaagttattacgtagtagccaatgggcagaaatttttgaatttaaaatgctcagcttcatctacgtggaagccattgcctgctctagtttggtcatttgatcgccgaaacagccccagactttcagcctgtttaggcagctggaacttgttctggaaaaggaaagatgaagatagttctgatgtgctaagaatcttagtgcctagaacttgttctggaaaaggaaagatgaagatagttctgatgcaccaagaatcttggtgcctagcatttatatttttggaattgaattttgaaattattttggccagtgaactcagcttttttttaaaaaaaattaattgtggtaaaatacaggtaacataaaatttaccgtcttaactatttttaagtgtatagttcagtagtgttaagttattcacatggttgtgcactgttaaaagaaaaactttagacacattaaatctaacggagtttgagcacagaatgatttgcgaattgggcaggtcccggaaccagaataagg

SEQ ID NO: 193221 - DNA, 876 bp, Homo sapiens
  Payload ID: 18144
  Gene Name: transmembrane BAX inhibitor motif containing 4
  ENST ID: ENST00000633367
  CDS Start-End: 77-217
gggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatgggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatga

SEQ ID NO: 193222 - DNA, 624 bp, Homo sapiens
  Payload ID: 18145
  Gene Name: transmembrane BAX inhibitor motif containing 4 [Source:EntrezGene
  Acc:51643]
  ENST ID: ENST00000632662
  CDS Start-End: 1-624
atggcagcagcgtggcctccgccaccgtgcacatccgaatgggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaa

SEQ ID NO: 193223 - DNA, 2836 bp, Homo sapiens
  Payload ID: 18146
  Gene Name: transmembrane BAX inhibitor motif containing 6
  Uniprot ID: P55061
  ENST ID: ENST00000267115
  CDS Start-End: 86-799
agagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctt

SEQ ID NO: 193224 - DNA, 2598 bp, Homo sapiens
  Payload ID: 18146
  Gene Name: transmembrane BAX inhibitor motif containing 6
  Uniprot ID: P55061
  ENST ID: ENST00000395006
  CDS Start-End: 39-752
ttctgcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaaca

SEQ ID NO: 193225 - DNA, 3254 bp, Homo sapiens
  Payload ID: 18146
  Gene Name: transmembrane BAX inhibitor motif containing 6
  Uniprot ID: P55061
  ENST ID: ENST00000423828
  CDS Start-End: 329-1216
acagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 193226 - DNA, 538 bp, Homo sapiens
  Payload ID: 18146
  Gene Name: transmembrane BAX inhibitor motif containing 6
  ENST ID: ENST00000549966
  CDS Start-End: 214-538
aagtgggcgagtcagagcacatccggtgttagaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaaccttggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctg

SEQ ID NO: 193227 - DNA, 2964 bp, Homo sapiens
  Payload ID: 18146
  Gene Name: transmembrane BAX inhibitor motif containing 6
  Uniprot ID: P55061
  ENST ID: ENST00000552699
  CDS Start-End: 236-1123
agagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaa

SEQ ID NO: 193228 - DNA, 2494 bp, Homo sapiens
  Payload ID: 18146
  Gene Name: transmembrane BAX inhibitor motif containing 6
  ENST ID: ENST00000547798
  CDS Start-End: 65-667
ttttcttagaaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaag

SEQ ID NO: 193229 - DNA, 373 bp, Homo sapiens
  Payload ID: 18146
  Gene Name: transmembrane BAX inhibitor motif containing 6
  ENST ID: ENST00000548894
  CDS Start-End: 325-373
agagcacatccggtgttagaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctgagtggagactgctgcacggactctggaaccatgaacatatttgatcgaaagatcaactttgatgcgcttttaaaatttt

SEQ ID NO: 193230 - DNA, 669 bp, Homo sapiens
  Payload ID: 18146
  Gene Name: transmembrane BAX inhibitor motif containing 6
  ENST ID: ENST00000547187
  CDS Start-End: 383-669
ggcgagtcagagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtttctaaccaaactgcatgcagcccttcgtagtttttatacacattttgttttccaaagatggtgttcgagaccaaggagagaaaggctgtctccttgacttaaaggttacctaagtgaccccttgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagg

SEQ ID NO: 193231 - DNA, 551 bp, Homo sapiens
  Payload ID: 18146
  Gene Name: transmembrane BAX inhibitor motif containing 6
  ENST ID: ENST00000548713
  CDS Start-End: 521-551
gaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacaggacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaagagtggagactgctgcacggactctggaaccatgaacatatttgatcgaaagatcaactttg

SEQ ID NO: 193232 - DNA, 2771 bp, Homo sapiens
  Payload ID: 18146
  Gene Name: transmembrane BAX inhibitor motif containing 6
  Uniprot ID: P55061
  ENST ID: ENST00000549385
  CDS Start-End: 228-941
agaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaa

SEQ ID NO: 193233 - DNA, 640 bp, Homo sapiens
  Payload ID: 18146
  Gene Name: transmembrane BAX inhibitor motif containing 6
  ENST ID: ENST00000547832
  CDS Start-End: 226-640
tgggcgagtcagagcacatccggtgttagaagcgctggtaggccttggagaggcgggttaggaagagtttctaaccaaactgcatgcagcccttcgtagtttttatacacattttgttttccaaagatggtgttcgagaccaaggagagaaaggctgtctccttgacttaaaggttacctaagtgaccccttgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgta

SEQ ID NO: 193234 - DNA, 521 bp, Homo sapiens
  Payload ID: 18146
  Gene Name: transmembrane BAX inhibitor motif containing 6
  ENST ID: ENST00000546914
  CDS Start-End: 235-521
agagcacatccggtgttagaagcgctggtaggccttggagaggcgggttaggaagtagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagg

SEQ ID NO: 193235 - DNA, 469 bp, Homo sapiens
  Payload ID: 18146
  Gene Name: transmembrane BAX inhibitor motif containing 6
  ENST ID: ENST00000548809
  CDS Start-End: 437-469
tggcggcctcagccggcatcgaatcaccgcggttcccagagggcgtgaggggctggcgtggacacaccgggaatggaccgtaccctttttcaaaaggaactcatgatgtatacaaatagaatgctcttccccttctttgctggccaattcctactcatctgttaaaaccaagcttagagattacctctttgatgacatctctaccaagtctgattgagaacatctctgtgagcacatagtattctaacatctctatcatcataccatgaaatcatcagactaaagccagaatcccaagactgcagcgctaccccttcacaagccgtcgggctgtcccgggcggggccggcccattttcactttctccactagaggcagcagcgcaccgtgaccctggcttactacgagtggagactgctgcacggactctggaaccatgaacatatttgatcgaaagatcaactttgat

SEQ ID NO: 193236 - DNA, 533 bp, Homo sapiens
  Payload ID: 18146
  Gene Name: transmembrane BAX inhibitor motif containing 6
  ENST ID: ENST00000550951
  CDS Start-End: 401-533
gttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcagggg

SEQ ID NO: 193237 - DNA, 759 bp, Homo sapiens
  Payload ID: 18146
  Gene Name: transmembrane BAX inhibitor motif containing 6
  ENST ID: ENST00000549445
  CDS Start-End: 473-759
ggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctgagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagg

SEQ ID NO: 193238 - DNA, 761 bp, Homo sapiens
  Payload ID: 18146
  Gene Name: transmembrane BAX inhibitor motif containing 6
  ENST ID: ENST00000550445
  CDS Start-End: 325-761
gggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtat

SEQ ID NO: 193239 - DNA, 574 bp, Homo sapiens
  Payload ID: 18146
  Gene Name: transmembrane BAX inhibitor motif containing 6
  ENST ID: ENST00000552635
  CDS Start-End: 86-427
agagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcccttaatctaatggtctttttttctaacagcatccttcccactgctttcatgggcacggcaatgatctttacctgcttcaccctcagtgcactctatgccaggcgccgtagctacctctttctgggaggtatcttgatgtcagccctgagctt

SEQ ID NO: 193240 - DNA, 882 bp, Homo sapiens
  Payload ID: 18146
  Gene Name: transmembrane BAX inhibitor motif containing 6
  Uniprot ID: P55061
  ENST ID: ENST00000552370
  CDS Start-End: 117-830
ctcagaggagagagcaacaaccttagtaggttctgcagcttctcactgtatctgtccttaagaacagaattaacaaaagttctgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatt

SEQ ID NO: 193241 - DNA, 556 bp, Homo sapiens
  Payload ID: 18146
  Gene Name: transmembrane BAX inhibitor motif containing 6
  ENST ID: ENST00000546796
  CDS Start-End: 121-556
ttccttaaaatttggacttgtacagtaaggacttcaactgaccttcctcagactgaggactgttcccagtgtatacatcaagtcactgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggta

SEQ ID NO: 193242 - DNA, 582 bp, Homo sapiens
  Payload ID: 18146
  Gene Name: transmembrane BAX inhibitor motif containing 6
  ENST ID: ENST00000548201
  CDS Start-End: 192-582
gaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacaggagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctca

SEQ ID NO: 193243 - DNA, 446 bp, Homo sapiens
  Payload ID: 18146
  Gene Name: transmembrane BAX inhibitor motif containing 6
  ENST ID: ENST00000549130
  CDS Start-End: 180-446
tagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgct

SEQ ID NO: 193244 - DNA, 423 bp, Homo sapiens
  Payload ID: 18146
  Gene Name: transmembrane BAX inhibitor motif containing 6
  ENST ID: ENST00000551154
  CDS Start-End: 301-423
tcagccggcatcgaatcaccgcggttcccagagggcgtgaggggctggcgtggacacaccgggaatggaccgtaccctttttcaaaaggaactcatgatgtatacaaatagaatgctcttccccttctttgctggccaattcctactcatctgttaaaaccaagcttagagattacctctttgatgacatctctaccaagtctgattgagaacatctctgtgagcacatagtattctaacatctctatcatcataccatgaaatcatcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcg

SEQ ID NO: 193245 - DNA, 3201 bp, Homo sapiens
  Payload ID: 18147
  Gene Name: transmembrane channel-like 1
  Uniprot ID: Q8TDI8
  ENST ID: ENST00000297784
  CDS Start-End: 541-2823
cagaaactatgagggcagaacccagcaatctgtgctttctttcacaagccctccaggagttgctgaaatttaggaatcattgccccaaaaagtggccctcataatgatgccagatgggatcttactctgttgcccaggctggagtgcagtggtgcgatctcggctctctgcaacctccgcctcccaggttcaagtgattctcctgcctcggcctcctgagtagctgggatttcaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaagtccctctccaaactagccagccactgagaccttctgacaggacacccccaggatgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcatatgaactttcattttatatgtttcttttgcc

SEQ ID NO: 193246 - DNA, 3068 bp, Homo sapiens
  Payload ID: 18147
  Gene Name: transmembrane channel-like 1
  Uniprot ID: Q8TDI8
  ENST ID: ENST00000340019
  CDS Start-End: 408-2690
ttcacaaagttggtttacagcagaactgtgctacagttatctggattcagatccaagtcccctccaaatgaatcacaaccacttctacctttataattccaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaagtccctctccaaactagccagccactgagaccttctgacaggacacccccaggatgtcacccaaaaaagtacaaatcaaagtggaggaaaaagaagacgagactgaggaaagctcaagtgaagaggaagaggaggtggaagataagctacctcgaagagagagcttgagaccaaagaggaaacggaccagagatgttatcaatgaggatgacccagaacctgaaccagaggatgaagaaacaaggaaggcaagagaaaaagagaggaggaggaggctaaagagaggagcagaagaagaagaaattgatgaagaggaattggaaagattgaaggcagagttagatgagaaaagacaaataattgctactgtcaaatgcaaaccatggaagatggagaagaaaattgaagttctcaaggaggcaaaaaaatttgtgagtgaaaatgaaggggctcttgggaaaggaaaaggaaaacggtggtttgcatttaagatgatgatggccaagaaatgggcaaaattcctccgtgattttgagaacttcaaagctgcgtgtgtcccatgggaaaataaaatcaaggctattgaaagtcagtttggctcctcagtggcctcatacttcctcttcttgagatggatgtatggagtcaatatggttctctttatcctgacatttagcctcatcatgttgccagagtacctctggggtttgccatatggcagtttacctaggaaaaccgttcccagagccgaagaggcatcggcagcaaactttggtgtgttgtacgacttcaatggtttggcacaatattccgttctcttttatggctattatgacaataaacgaacaattggatggatgaatttcaggttgccgctctcctattttctagtggggattatgtgcattggatacagctttctggttgtcctcaaagcaatgaccaaaaacattggtgatgatggaggtggagatgacaacactttcaatttcagctggaaggtctttaccagctgggactacctgatcggcaatcctgaaacagcagacaacaaatttaattctatcacaatgaactttaaggaagctatcacagaagaaaaagcagcccaagtagaagaaaacgtccacttgatcagattcctgaggtttctggctaacttcttcgtgtttctaacacttggagggagtggatacctcatcttttgggctgtgaagcgatcccaggaatttgcacagcaagatcctgacacccttgggtggtgggaaaaaaatgaaatgaacatggttatgtccctcctagggatgttctgtccaacattgtttgacttatttgctgaattagaagactaccatcctctcatcgctttgaaatggctactgggacgcatttttgctcttcttttaggcaatttatacgtatttattcttgcattaatggatgagattaacaacaagattgaagaggagaagctagtaaaggccaatattaccctttgggaagccaatatgatcaaggcctacaatgcatcattctctgaaaatagcactggaccacccttttttgttcaccctgcagatgtacctcgaggaccttgctgggaaacaatggtgggacaggagtttgtgaggctgacagtctctgatgttctgaccacctacgtcacaatcctcattggggactttctaagggcatgttttgtgaggttttgcaattattgctggtgctgggacttggagtatggatatccttcatacaccgaattcgacatcagtggcaacgtcctcgctctgatcttcaaccaaggcatgatctggatgggctccttctttgctcccagcctcccaggcatcaatatccttcgactccatacatccatgtacttccagtgctgggccgttatgtgctgcaatgttcctgaggccagggtcttcaaagcttccagatcaaataacttctacctgggcatgctactgctcatcctcttcctgtccacaatgcctgtcttgtacatgatcgtgtccctcccaccatcttttgattgtggtccattcagtggcaaaaatagaatgtttgaagtcattggagagaccctggagcacgatttcccaagctggatggcgaagatcttgagacagctttcaaaccctgggctggtcattgctgtcattttggtgatggttttggccatctattatctcaatgctactgccaagggccagaaggcagcgaatctggatctcaaaaagaagatgaaaatgcaagctttggagaacaaaatgcgaaacaagaaaatggcagctgcacgagcagctgcagctgctggtcgccagtaataagtatcctgagagcccagaaaaggtacactttgccttgctgtttaaaagtaatgcaatatgtgaacgcccagagaacaagcactgtggaactgctattttcctgttctacccttgatggattttcaaggtcatgctggccaattaaggcatcatcagtcctacctgagcaacaagaatctaaactttattccaagtcagaaactgtttctgcagagccactctctcccctgctccatttcgtgactttttttttttttttaacaaattgagtttagaagtgagtgtaatccagcaatacagtttactggtttagttggtgggttaattaaaaaaaatttgctcatatgaactttcattttatatgtttcttttgcc

SEQ ID NO: 193247 - DNA, 3169 bp, Homo sapiens
  Payload ID: 18148
  Gene Name: transmembrane channel-like 2
  Uniprot ID: Q8TDI7
  ENST ID: ENST00000358864
  CDS Start-End: 16-2736
gcagtgctgctgaccatgagccaccaggtaaagggcctgaaagaggaagcacgaggcggagtgaaagggcgggtgaagagcggctctccacacacaggtgacaggctgggaaggagatcctcaagcaagcgggctctcaaagccgaggggaccccaggcaggcgcggagctcagcgaagccagaaggagcgcgccgggggcagcccaagcccggggtctccccggaggaagcaaacagggcgcaggagacacagagaagagctgggggagcaggagcggggcgaggcagagaggacctgcgagggcaggagaaagcgcgacgagagggcctccttccaggagcggacagcagccccaaagagggaaaaggagattccgaggagggaggagaagtcgaagcggcagaagaaacccaggtcatcctccttggcctccagtgcctctggtggggagtccctgtccgaggaggaactggcccagatcctggagcaggtggaagaaaaaaagaagctcattgccaccatgcggagcaagccctggcccatggcgaagaagctgacagagctcagggaggcccaggaatttgtggagaagtatgaaggtgccttgggaaaggggaaaggcaagcaactatatgcctacaagatgctgatggccaagaaatgggtcaaatttaagagagactttgataatttcaagactcaatgtatcccctgggaaatgaagatcaaggacattgaaagtcactttggttcttcagtggcatcgtatttcatctttctccgatggatgtatggagttaaccttgtcctttttggcttaatatttggtctagtcataatcccagaggtactgatgggcatgccctatgggagtattcccagaaagacagtgcctcgggctgaggaagaaaaggccatggatttttctgtcctttgggattttgagggctatatcaagtactctgcactcttctatggctactacaacaaccagaggaccatcgggtggctgaggtaccggctgcctatggcttactttatggtgggggtcagcgtgttcggctacagcctgattattgtcattcgatcgatggccagcaatacccaaggaagcacaggcgaaggggagagtgacaacttcacattcagcttcaagatgttcaccagctgggactacctgatcgggaattcagagacagctgataacaaatatgcatccatcaccaccagcttcaaggaatcaatagtggatgaacaagagagtaacaaagaagaaaatatccatctgacaagatttcttcgtgtcctggccaactttctcatcatctgctgtttgtgtggaagtgggtacctcatttactttgtggttaagcgatctcagcaattctccaaaatgcagaatgtcagctggtatgaaaggaatgaggtagagatcgtgatgtccctgcttggaatgttttgtccccctctgtttgaaaccatcgctgccctggagaattaccacccacgcactggactgaagtggcagctgggacgcatctttgcactcttcctggggaacctctacacatttctcttggccctgatggatgacgtccacctcaagcttgctaatgaagagacaataaagaacatcactcactggactctgtttaactattacaactcttctggttggaacgagagtgtcccccgaccacccctgcaccctgcagatgtgccccggggttcttgctgggagacagctgtgggcattgaattcatgaggctgacggtgtctgacatgctggtaacgtacatcaccatcctgctgggggacttcctacgggcttgttttgtgcggttcatgaactactgctggtgctgggacttggaggctggatttccttcatatgctgagtttgatattagtggaaatgtgctgggtttgatcttcaaccaaggaatgatctggatgggctccttctatgctccaggcctggtgggcattaatgtgctgcgcctgctgacctccatgtacttccagtgctgggcggtgatgagcagcaacgtaccccatgaacgcgtgttcaaagcctcccgatccaacaacttctacatgggcctcctgctgctggtgctcttcctcagcctcctgccggtggcctacaccatcatgtccctcccaccctcctttgactgcgggccgttcagtgggaaaaacagaatgtacgatgtcctccaagagaccattgaaaacgatttcccaaccttcctgggcaagatctttgctttcctcgccaatccaggcctgatcatcccagccatcctgctgatgttcttggccatttactacctgaactcagtttccaaaagcctttcccgagctaatgcccagctgaggaagaaaatccaagtgctccgtgaagttgagaagagtcacaaatctgtaaaaggcaaagccacagccagagattcagaggacacacctaaaagcagctccaaaaatgccacccagctccaactcaccaaggaagagaccactcctccctctgccagccaaagccaggccatggacaagaaggcgcagggccctgggacctccaattctgccagcaggaccacactgcctgcctctggacaccttcctatatctcggccccctggaatcggaccagattctggccacgccccatctcagactcatccgtggaggtcagcctctggaaagagtgctcagagacctccccactgatggctaggactccagggagcctcgaccctagggctgatcctcaagtaccccagtttcacacataccaaaccaaggttctctcccctctttcctctcacatacatgctctgtctcctctcttggaatgcatgaactttgattccttcaggcccttgtcagctaccgaaggaggaagacagtggcttcacctgtcctttagggaagctggagccatctctgcactaactgccctcccaaatatcttggttcagacagctctgaaccccacgctcacagtggtcgaccttgcctcccgattttcggagttggggaagggccatgaccaccctcgtagactttttccatgggatacagtttaggacacgggtttctgccagcttccctaaccaggagggggatggagaagggcctacatttctcaatccagaggaag

SEQ ID NO: 193248 - DNA, 4641 bp, Homo sapiens
  Payload ID: 18149
  Gene Name: transmembrane channel-like 3
  Uniprot ID: Q7Z5M5
  ENST ID: ENST00000359440
  CDS Start-End: 137-3439
acacagtcttcttcctgagaactagcgggcagagcaaactccgctgcttccattcagaaacctcggaacagacctttgcctgccaacttcctagctctctggccagcttctgattgttagcagtgggttagctcccatgaaaacctcgaaggcatcccagcgctatagaggcatccggagaaatgccagccagtgctacctctaccaggaatctctgctgctcagcaacttggatgacagctttagtgctgatgaaacaggggacagcaatgatccggaacaaatcttccagaatatacagttccagaaagatctcatggcaaacattcgctgcagaccctggactatgggacagaagctgagggcattgagacaagcgaagaacattgtgctgaagtttgaagggaggctgaccaggacccgaggctaccaagcagcaggtgcagagctctggcggaaatttgctcgtctcgcctgtaactttgtggtcatcttcattccctgggaaatgaggataaagaaaatcgagagtcattttggatctggcgttgcctcctatttcatattcttgagatggttatttggaattaatattgtgctcaccattatgacaggtgcttttattgtcattccagagctgattgcaggccagccctttggaagcacagccaggaagaccatccccaaggagcaggtttcgtctgcccaagacctggacaccgtctggtctctggggggctacctccagtactctgtcctcttctacggatattacggcagggagaggaagatcgggagagctggctaccggctgcccttggcgtatttcctagtggggatggcagtgtttgcttacagcttcatcattcttttaaaaaagatggctaagaactcccgcacgagtcttgccagtgcttccaatgaaaactataccttctgctggcgggtgttctgtgcctgggattacctcattggaaacccagaggctgcagagagcaaaacagctgccatagtgaacagcatcagggaagctatattggaagaacaggagaaaaagaaaagcaaaaacctggcagtgaccatctgcctgaggattattgccaacatcctggtgcttctctcactggctgggagcatttatctcatctactttgtggtggaccggtcccagaagctggagcagtcgaagaaggagctgacactttgggaaaagaatgaggtcagtgtggtggtctccctcgtcaccatgatagcaccatcagcctttgacctcattgctgccttagagatgtaccaccccaggaccacgctgcgcttccagcttgcaagggtccttgtgctgtatttgggaaatctctacagcctgatcattgctctcctggacaaagttaacagcatgagcattgaggaaatggctaccaaaaataacacaagtcattggatagattccaccaccttctttgcaaccaggacagcccctgaagaagagaaatggtccacatctcggcctggaatggggctcaggagaaacaacacatgggccttggaagagaccagcatttcagcttataccatgcctcttataaaggccaacaagactagcctccacactcagagtccacaagaccagtgctgggagacatacgttggtcaggagatgctgaagctctccatcattgacatgctcttcaccgtggcgagcattctgctcatagacttcttccgaggacttttcgtgcggtacttaagtgactactggtgttgggatctggagagcaagtttcctgaatatggagaattcaaaatagctgagaatgtgctacatttagtctacaaccaaggaatgatttggatgggggccttcttctccccatgtctcccagcgttcaacgttctcaaactcattgggctcatgtacctgagaagctgggctgtgctgacctgcaatgtgccccaccagcaagtatttcgagcctcaagatccaacaacttctacttggcaatgctcctgtttatgctgtttctgtgcatgctgccaaccatttttgctattgtccgatacaagccatctctaaactgtgggccattcagtggacaagagaaaatttatgacattgtgtcagaaacgattgagaaagactttcctgtgtggtttggctccgtggttggacacatcagtagccccgtggtcatcctgcccgcagtactcctgcttttcatgctcatctattatctccagagcatcgcacggtctctaaagctcagcaaccaccagctcaaaatgcagatccaaaacgcaagatcagaggataagaaaaaggttgcccagatggtagaagcccgaatccagacccaggaagaaagcaccaagaagcttccaaacgacagtgatcttaccagccagctgtcctcagcgcactcgggcacaccccaaaacaacggcaacgtggcccattttgactcagggagcagcaagagtggcaggatagagacagtcgcacagtccatgccccagagcccgaggccaggggacagggctcctagctcacctctccctggggtccccaaatccaggctagagcatgaaactaacaggtatctgcacggtctgtgtgcaagcaccagtgaccttcacaggaacagatcgcgcacacctatgacatttacaacgcacatcgaagatgtacactcagaacctcttttccgaaaagactttcagcaaatcaaccctcctcaccgtggaccacaggcctcgactttgctggcacagggtcccaggccccacgcccccagatactatgtcattaatgaatgtgactcttacaagaaaaaacatctaaatgtctggccagaaagacatttcaagatagatgcttcaggtgacattgtggagctgtaccccaggaacgtgcgacaatatgcatcccgggtcccccgccagcctccctccccacagctgagtgaagaagaggaggagacgccaagcagagattggatcaaacggtctcttcccccacgctccctgatagacctccgtcgggctcctcatttttatattggggagaggtccgaaagtcagacccgggatcccgagcaccaggggagggtgcactacaagtcgtggaatgaagattttgagggtcaccttgagaggccagcctatgtgcccagaaagccacgatcccggaatttccaatacccacagccccctctgaagcccagagggaagcccaggttcgagccatccctcacggaatctgactccgtgtcggcagcatccagcagtgaccagcagaacagcagcgctgaccagtacctgcaggtcacccacagccagggcaggttcccgaggtccgtgggccagcccagcaggaggaaggccaagtcggggcaggagctgaccgtggatctggatgacttgatttgttcagatgtctaggcttcctccagtgtcccgttcctagaggtcaggcccctgttggagtgctgggccagcacatggcatctccctttctggaaaaagaggtgaacaagtgtgttagagacctgaggggcatggtcagcggctgctagctgaggccctgaggctgacagggctacagatacctattctacagctactgttagccaaatttatccgagttaggtggcaccaaagtatgtcaccagcagtgaatcatcacgggtctgcagcaatctcaatacttgcctcctcggaagaaagaatttggcagaggggctcaagacagaaggagagactgaggcaagttttagagcaggcatgaaagtttactgaaaagctttaaagcaggaatgaaagaacgtaaaacatacttagtagagggccaagcaggcgacttgagagatccagtgcactgtttgacctttgacttggggttttacacgttggcatgcttccggggtcttgcgttgcttctccccacgattcttccctttcttcccttggggtgggctgtccgcatgcgcagtagtggcctgctagcgctggggaggggagcatgcgcagtgtgtttactggagttgtgcacgcgctcactcgaggttcttcccttaccaggggaatgctccattttgtctcttagtgcgcatgtttgagcccactcgcccaactcctgacattttatggggaagctgccgatcaccagtttcaggttttttctatctattgggagactgtcgttccctggtgccagctgtgaccaattattattttagagagacaatcagcagccacctgaccatcacctgatggtcgcctgacattcctgggggttgtgttgaagaaggaattcatgaattttacaagtataatcaaagacaaccaaaaatttttactttttccttcaaaagctaagtgtagtgtagctcccccatagtctaagttaaagaagaacactaactgcctgtttttccttctgtgctcagcaagccttatctgtacttgctagtttcacattccttgaggctcagcgagttcctgcttcaccaccctagcgcagctgcaaagttacaaggttgatgcagaaacatggtttcccagggatgtggaacatgtagtatagataaatgtaaaagactgaacaactgcctttgctctcgcttctgtaagtacgcttcctg

SEQ ID NO: 193249 - DNA, 4644 bp, Homo sapiens
  Payload ID: 18149
  Gene Name: transmembrane channel-like 3
  ENST ID: ENST00000558726
  CDS Start-End: 137-3442
acacagtcttcttcctgagaactagcgggcagagcaaactccgctgcttccattcagaaacctcggaacagacctttgcctgccaacttcctagctctctggccagcttctgattgttagcagtgggttagctcccatgaaaacctcgaaggcatcccagcgctatagaggcatccggagaaatgccagccagtgctacctctaccaggaatctctgctgctcagcaacttggatgacagctttagtgctgatgaaacaggggacagcaatgatccggaacaaatcttccagaatatacagttccagaaagatctcatggcaaacattcgctgcagaccctggactatgggacagaagctgagggcattgagacaagcgaagaacattgtgctgaagtttgaagggaggctgaccaggacccgaggctaccaagcagcaggtgcagagctctggcggaaatttgctcgtctcgcctgtaactttgtggtcatcttcattccctgggaaatgaggataaagaaaatcgagagtcattttggatctggcgttgcctcctatttcatattcttgagatggttatttggaattaatattgtgctcaccattatgacaggtgcttttattgtcattccagagctgattgcaggccagccctttggaagcacagccaggaagaccatccccaaggagcaggtttcgtctgcccaagacctggacaccgtctggtctctggggggctacctccagtactctgtcctcttctacggatattacggcagggagaggaagatcgggagagctggctaccggctgcccttggcgtatttcctagtggggatggcagtgtttgcttacagcttcatcattcttttaaaaaagatggctaagaactcccgcacgagtcttgccagtgcttccaatgaaaactataccttctgctggcgggtgttctgtgcctgggattacctcattggaaacccagaggctgcagagagcaaaacagctgccatagtgaacagcatcagggaagctatattggaagaacaggagaaaaagaaaagcaaaaacctggcagtgaccatctgcctgaggattattgccaacatcctggtgcttctctcactggctgggagcatttatctcatctactttgtggtggaccggtcccagaagctggagcagtcgaagaaggagctgacactttgggaaaagaatgagcaggtcagtgtggtggtctccctcgtcaccatgatagcaccatcagcctttgacctcattgctgccttagagatgtaccaccccaggaccacgctgcgcttccagcttgcaagggtccttgtgctgtatttgggaaatctctacagcctgatcattgctctcctggacaaagttaacagcatgagcattgaggaaatggctaccaaaaataacacaagtcattggatagattccaccaccttctttgcaaccaggacagcccctgaagaagagaaatggtccacatctcggcctggaatggggctcaggagaaacaacacatgggccttggaagagaccagcatttcagcttataccatgcctcttataaaggccaacaagactagcctccacactcagagtccacaagaccagtgctgggagacatacgttggtcaggagatgctgaagctctccatcattgacatgctcttcaccgtggcgagcattctgctcatagacttcttccgaggacttttcgtgcggtacttaagtgactactggtgttgggatctggagagcaagtttcctgaatatggagaattcaaaatagctgagaatgtgctacatttagtctacaaccaaggaatgatttggatgggggccttcttctccccatgtctcccagcgttcaacgttctcaaactcattgggctcatgtacctgagaagctgggctgtgctgacctgcaatgtgccccaccagcaagtatttcgagcctcaagatccaacaacttctacttggcaatgctcctgtttatgctgtttctgtgcatgctgccaaccatttttgctattgtccgatacaagccatctctaaactgtgggccattcagtggacaagagaaaatttatgacattgtgtcagaaacgattgagaaagactttcctgtgtggtttggctccgtggttggacacatcagtagccccgtggtcatcctgcccgcagtactcctgcttttcatgctcatctattatctccagagcatcgcacggtctctaaagctcagcaaccaccagctcaaaatgcagatccaaaacgcaagatcagaggataagaaaaaggttgcccagatggtagaagcccgaatccagacccaggaagaaagcaccaagaagcttccaaacgacagtgatcttaccagccagctgtcctcagcgcactcgggcacaccccaaaacaacggcaacgtggcccattttgactcagggagcagcaagagtggcaggatagagacagtcgcacagtccatgccccagagcccgaggccaggggacagggctcctagctcacctctccctggggtccccaaatccaggctagagcatgaaactaacaggtatctgcacggtctgtgtgcaagcaccagtgaccttcacaggaacagatcgcgcacacctatgacatttacaacgcacatcgaagatgtacactcagaacctcttttccgaaaagactttcagcaaatcaaccctcctcaccgtggaccacaggcctcgactttgctggcacagggtcccaggccccacgcccccagatactatgtcattaatgaatgtgactcttacaagaaaaaacatctaaatgtctggccagaaagacatttcaagatagatgcttcaggtgacattgtggagctgtaccccaggaacgtgcgacaatatgcatcccgggtcccccgccagcctccctccccacagctgagtgaagaagaggaggagacgccaagcagagattggatcaaacggtctcttcccccacgctccctgatagacctccgtcgggctcctcatttttatattggggagaggtccgaaagtcagacccgggatcccgagcaccaggggagggtgcactacaagtcgtggaatgaagattttgagggtcaccttgagaggccagcctatgtgcccagaaagccacgatcccggaatttccaatacccacagccccctctgaagcccagagggaagcccaggttcgagccatccctcacggaatctgactccgtgtcggcagcatccagcagtgaccagcagaacagcagcgctgaccagtacctgcaggtcacccacagccagggcaggttcccgaggtccgtgggccagcccagcaggaggaaggccaagtcggggcaggagctgaccgtggatctggatgacttgatttgttcagatgtctaggcttcctccagtgtcccgttcctagaggtcaggcccctgttggagtgctgggccagcacatggcatctccctttctggaaaaagaggtgaacaagtgtgttagagacctgaggggcatggtcagcggctgctagctgaggccctgaggctgacagggctacagatacctattctacagctactgttagccaaatttatccgagttaggtggcaccaaagtatgtcaccagcagtgaatcatcacgggtctgcagcaatctcaatacttgcctcctcggaagaaagaatttggcagaggggctcaagacagaaggagagactgaggcaagttttagagcaggcatgaaagtttactgaaaagctttaaagcaggaatgaaagaacgtaaaacatacttagtagagggccaagcaggcgacttgagagatccagtgcactgtttgacctttgacttggggttttacacgttggcatgcttccggggtcttgcgttgcttctccccacgattcttccctttcttcccttggggtgggctgtccgcatgcgcagtagtggcctgctagcgctggggaggggagcatgcgcagtgtgtttactggagttgtgcacgcgctcactcgaggttcttcccttaccaggggaatgctccattttgtctcttagtgcgcatgtttgagcccactcgcccaactcctgacattttatggggaagctgccgatcaccagtttcaggttttttctatctattgggagactgtcgttccctggtgccagctgtgaccaattattattttagagagacaatcagcagccacctgaccatcacctgatggtcgcctgacattcctgggggttgtgttgaagaaggaattcatgaattttacaagtataatcaaagacaaccaaaaatttttactttttccttcaaaagctaagtgtagtgtagctcccccatagtctaagttaaagaagaacactaactgcctgtttttccttctgtgctcagcaagccttatctgtacttgctagtttcacattccttgaggctcagcgagttcctgcttcaccaccctagcgcagctgcaaagttacaaggttgatgcagaaacatggtttcccagggatgtggaacatgtagtatagataaatgtaaaagactgaacaactgcctttgctctcgcttctgtaagtacgcttcctg

SEQ ID NO: 193250 - DNA, 757 bp, Homo sapiens
  Payload ID: 18150
  Gene Name: transmembrane channel-like 4
  ENST ID: ENST00000446291
  CDS Start-End: 231-757
gggaaaaggaagttaaagcctggactccactgccctggagcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcg

SEQ ID NO: 193251 - DNA, 2413 bp, Homo sapiens
  Payload ID: 18150
  Gene Name: transmembrane channel-like 4
  ENST ID: ENST00000617472
  CDS Start-End: 134-2272
ctgagaaaccacaggaagtgtaccttactccctccgggccacctgctggccaggtacacacctgcccctggcccctcccttacctggggcagtgtctgcctggtggccactagagacagcccagcctggggccatggaagaaaacccgaccttggaatcagaagcctggggctcctctagggagtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgcca

SEQ ID NO: 193252 - DNA, 2412 bp, Homo sapiens
  Payload ID: 18150
  Gene Name: transmembrane channel-like 4
  ENST ID: ENST00000620520
  CDS Start-End: 133-2271
ctgagaaaccacaggaagtgtaccttactccctccgggccacctgctggccaggtacacacctgcccctggcccctcccttacctggggcagtgtctgcctggtggccactagagacagcccagcctgggccatggaagaaaacccgaccttggaatcagaagcctggggctcctctagggggtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgcca

SEQ ID NO: 193253 - DNA, 2412 bp, Homo sapiens; identical to SEQ ID NO: 193252
  Payload ID: 18150
  Gene Name: transmembrane channel-like 4
  ENST ID: ENST00000619470
  CDS Start-End: 133-2271

SEQ ID NO: 193254 - DNA, 2412 bp, Homo sapiens; identical to SEQ ID NO: 193252
  Payload ID: 18150
  Gene Name: transmembrane channel-like 4
  Uniprot ID: Q7Z404
  ENST ID: ENST00000618950
  CDS Start-End: 133-2271

SEQ ID NO: 193255 - DNA, 2373 bp, Homo sapiens
  Payload ID: 18150
  Gene Name: transmembrane channel-like 4
  ENST ID: ENST00000619895
  CDS Start-End: 55-2175
ttacctggggcagtgtctgcctggtggccactagagacagcccagcctggggccatggaagaaaacccgaccttggaatcagaagcctggggctcctctagggagtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 193256 - DNA, 2374 bp, Homo sapiens
  Payload ID: 18150
  Gene Name: transmembrane channel-like 4
  ENST ID: ENST00000616977
  CDS Start-End: 56-2176
cttacctggggcagtgtctgcctggtggccactagagacagcccagcctggggccatggaagaaaacccgaccttggaatcagaagcctggggctcctctagggagtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcatacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 193257 - DNA, 2374 bp, Homo sapiens
  Payload ID: 18150
  Gene Name: transmembrane channel-like 4
  ENST ID: ENST00000612564
  CDS Start-End: 56-2176
cttacctggggcagtgtctgcctggtggccactagagacagcccagcctggggccatggaagaaaacccgaccttggaatcagaagcctggggctcctctagggagtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcatacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 193258 - DNA, 718 bp, Homo sapiens
  Payload ID: 18150
  Gene Name: transmembrane channel-like 4
  ENST ID: ENST00000610383
  CDS Start-End: 1-718
gcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcg

SEQ ID NO: 193259 - DNA, 2412 bp, Homo sapiens; identical to SEQ ID NO: 193252
  Payload ID: 18150
  Gene Name: transmembrane channel-like 4
  ENST ID: ENST00000613354
  CDS Start-End: 133-2271

SEQ ID NO: 193260 - DNA, 506 bp, Homo sapiens
  Payload ID: 18150
  Gene Name: transmembrane channel-like 4
  ENST ID: ENST00000615945
  CDS Start-End: 1-168
cctgagtctatttccagcctccctgagaccacccagaatttcctcttcttcctggggacccaggcttttgctgtgccccttctgctgatctccaggagccagacgtttggatataatggaagagcgtgtcaggagtggcttccgttcctgtctccttcagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 193261 - DNA, 2372 bp, Homo sapiens
  Payload ID: 18150
  Gene Name: transmembrane channel-like 4
  Uniprot ID: Q7Z404
  ENST ID: ENST00000621671
  CDS Start-End: 54-2174
ttacctggggcagtgtctgcctggtggccactagagacagcccagcctgggccatggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 193262 - DNA, 2412 bp, Homo sapiens; identical to SEQ ID NO: 193252
  Payload ID: 18150
  Gene Name: transmembrane channel-like 4
  Uniprot ID: Q7Z404
  ENST ID: ENST00000622368
  CDS Start-End: 133-2271

SEQ ID NO: 193263 - DNA, 2412 bp, Homo sapiens; identical to SEQ ID NO: 193252
  Payload ID: 18150
  Gene Name: transmembrane channel-like 4
  Uniprot ID: Q7Z404
  ENST ID: ENST00000612712
  CDS Start-End: 133-2271

SEQ ID NO: 193264 - DNA, 2413 bp, Homo sapiens
  Payload ID: 18150
  Gene Name: transmembrane channel-like 4
  ENST ID: ENST00000621539
  CDS Start-End: 134-2272
ctgagaaaccacaggaagtgtaccttactccctccgggccacctgctggccaggtacacacctgcccctggcccctcccttacctggggcagtgtctgcctggtggccactagagacagcccagcctggggccatggaagaaaacccgaccttggaatcagaagcctggggctcctctagggagtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcatacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgcca

SEQ ID NO: 193265 - DNA, 506 bp, Homo sapiens
  Payload ID: 18150
  Gene Name: transmembrane channel-like 4
  ENST ID: ENST00000619510
  CDS Start-End: 1-168
cctgagtctatttccagcctccctgagaccacccagaatttcctcttcttcctggggacccaggcttttgctgtgccccttctgctgatctccaggagccagacgtttggatataatggaagagcgtgtcaggagtggcttccgttcctgtctccttcagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga
